United States Patent
Wesche et al.

(10) Patent No.: US 11,136,403 B2
(45) Date of Patent: *Oct. 5, 2021

(54) TRISPECIFIC PROTEINS AND METHODS OF USE

(71) Applicant: HARPOON THERAPEUTICS, INC., South San Francisco, CA (US)

(72) Inventors: Holger Wesche, San Francisco, CA (US); Bryan D. Lemon, Mountain View, CA (US); Richard J. Austin, San Francisco, CA (US)

(73) Assignee: HARPOON THERAPEUTICS, INC., South San Francisco, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 16/159,554

(22) Filed: Oct. 12, 2018

(65) Prior Publication Data

US 2019/0112381 A1    Apr. 18, 2019

Related U.S. Application Data

(60) Provisional application No. 62/572,381, filed on Oct. 13, 2017.

(51) Int. Cl.
| | | |
|---|---|---|
| *A61K 39/00* | (2006.01) | |
| *C07K 16/28* | (2006.01) | |
| *A61P 35/00* | (2006.01) | |
| *C07K 16/18* | (2006.01) | |

(52) U.S. Cl.
CPC .......... *C07K 16/2878* (2013.01); *A61P 35/00* (2018.01); *C07K 16/18* (2013.01); *C07K 16/2809* (2013.01); *C07K 2317/21* (2013.01); *C07K 2317/24* (2013.01); *C07K 2317/31* (2013.01); *C07K 2317/56* (2013.01); *C07K 2317/565* (2013.01); *C07K 2317/569* (2013.01); *C07K 2317/622* (2013.01); *C07K 2317/732* (2013.01); *C07K 2317/76* (2013.01); *C07K 2317/92* (2013.01); *C07K 2319/30* (2013.01); *C07K 2319/31* (2013.01)

(58) Field of Classification Search
CPC .............................................. A61K 2039/505
See application file for complete search history.

(56) References Cited

U.S. PATENT DOCUMENTS

| | | |
|---|---|---|
| 4,816,567 A | 3/1989 | Cabilly et al. |
| 5,061,620 A | 10/1991 | Tsukamoto et al. |
| 5,199,942 A | 4/1993 | Gillis |
| 5,225,539 A | 7/1993 | Winter |
| 5,350,674 A | 9/1994 | Boenisch et al. |
| 5,399,346 A | 3/1995 | Anderson et al. |
| 5,530,101 A | 6/1996 | Queen et al. |
| 5,565,332 A | 10/1996 | Hoogenboom et al. |
| 5,580,859 A | 12/1996 | Felgner et al. |
| 5,585,089 A | 12/1996 | Queen et al. |
| 5,585,362 A | 12/1996 | Wilson et al. |
| 5,589,466 A | 12/1996 | Felgner et al. |
| 5,759,808 A | 6/1998 | Casterman et al. |
| 5,766,886 A | 6/1998 | Studnicka et al. |
| 5,773,292 A | 6/1998 | Bander |
| 5,800,988 A | 9/1998 | Casterman et al. |
| 5,840,526 A | 11/1998 | Casterman et al. |
| 5,858,358 A | 1/1999 | June et al. |
| 5,859,205 A | 1/1999 | Adair et al. |
| 5,874,541 A | 2/1999 | Casterman et al. |
| 5,883,223 A | 3/1999 | Gray |
| 6,005,079 A | 12/1999 | Casterman et al. |
| 6,015,695 A | 1/2000 | Casterman et al. |
| 6,107,090 A | 8/2000 | Bander |
| 6,120,766 A | 9/2000 | Hale et al. |
| 6,136,311 A | 10/2000 | Bander |
| 6,326,193 B1 | 12/2001 | Liu et al. |
| 6,331,415 B1 | 12/2001 | Cabilly et al. |
| 6,352,694 B1 | 3/2002 | June et al. |
| 6,407,213 B1 | 6/2002 | Carter et al. |
| 6,534,055 B1 | 3/2003 | June et al. |
| 6,548,640 B1 | 4/2003 | Winter |
| 6,670,453 B2 | 12/2003 | Frenken et al. |
| 6,692,964 B1 | 2/2004 | June et al. |
| 6,759,518 B1 | 7/2004 | Kontermann et al. |
| 6,767,711 B2 | 7/2004 | Bander |

(Continued)

FOREIGN PATENT DOCUMENTS

| | | |
|---|---|---|
| CN | 1563092 A | 1/2005 |
| CN | 101646689 A | 2/2010 |

(Continued)

OTHER PUBLICATIONS

Smirnova et al. (Mol. Immunol. Feb. 2008; 45 (4): 1179-83).*
Laabi et al. (Nucleic Acids Res. Apr. 11, 1994; 22 (7): 1147-54).*
Hipp et al. (Leukemia. Aug. 2017; 31 (8): 1743-1751).*
Tijink et al. (Mol. Cancer Ther. Aug. 2008; 7 (8): 2288-97).*
Chen et al. (Adv. Drug Deliv. Rev. Oct. 2013; 65 (10): 1357-69).*
Dennis et al. (Cancer Res. Jan. 1, 2007; 67 (1): 254-61).*
Ramadoss et al. (J. Am. Chem. Soc. Apr. 29, 2015; 137 (16): 5288-91).*

(Continued)

*Primary Examiner* — Stephen L Rawlings
(74) *Attorney, Agent, or Firm* — Wilson Sonsini Goodrich & Rosati

(57) ABSTRACT

Provided herein are B cell maturation agent (BCMA) targeting trispecific proteins comprising a domain binding to CD3, a half-life extension domain, and a domain binding to BCMA. Also provided are pharmaceutical compositions thereof, as well as nucleic acids, recombinant expression vectors and host cells for making such BCMA targeting trispecific proteins. Also disclosed are methods of using the disclosed BCMA targeting trispecific proteins in the prevention, and/or treatment diseases, conditions and disorders.

13 Claims, 37 Drawing Sheets

Specification includes a Sequence Listing.

(56) References Cited

U.S. PATENT DOCUMENTS

| | | |
|---|---|---|
| 6,797,514 B2 | 9/2004 | Berenson et al. |
| 6,867,041 B2 | 3/2005 | Berenson et al. |
| 6,887,466 B2 | 5/2005 | June et al. |
| 6,905,680 B2 | 6/2005 | June et al. |
| 6,905,681 B1 | 6/2005 | June et al. |
| 6,905,874 B2 | 6/2005 | Berenson et al. |
| 7,067,318 B2 | 6/2006 | June et al. |
| 7,144,575 B2 | 12/2006 | June et al. |
| 7,163,680 B2 | 1/2007 | Bander |
| 7,172,869 B2 | 2/2007 | June et al. |
| 7,175,843 B2 | 2/2007 | June et al. |
| 7,232,566 B2 | 6/2007 | June et al. |
| 7,262,276 B2 | 8/2007 | Huang et al. |
| 7,666,414 B2 | 2/2010 | Bander |
| 7,807,162 B2 | 10/2010 | Silence |
| 7,850,971 B2 | 12/2010 | Maddon et al. |
| 8,114,965 B2 | 2/2012 | Maddon et al. |
| 8,188,223 B2 | 5/2012 | Beirnaert et al. |
| 8,236,308 B2 | 8/2012 | Kischel et al. |
| 8,470,330 B2 | 6/2013 | Schuelke et al. |
| 8,623,356 B2 | 1/2014 | Christopherson et al. |
| 8,629,244 B2 | 1/2014 | Kolkman et al. |
| 8,703,135 B2 | 4/2014 | Beste et al. |
| 8,784,821 B1 | 7/2014 | Kufer et al. |
| 8,846,042 B2 | 9/2014 | Zhou |
| 8,907,071 B2 | 12/2014 | Sullivan et al. |
| 8,937,164 B2 | 1/2015 | Descamps et al. |
| 9,169,316 B2 | 10/2015 | Baty et al. |
| 9,309,327 B2 | 4/2016 | Humphreys et al. |
| 9,327,022 B2 | 5/2016 | Zhang et al. |
| 9,340,621 B2 | 5/2016 | Kufer et al. |
| 9,708,412 B2 | 7/2017 | Baeuerle et al. |
| 9,920,115 B2 | 3/2018 | Dubridge et al. |
| 10,066,016 B2 | 9/2018 | Dubridge et al. |
| 10,100,106 B2 | 10/2018 | Dubridge et al. |
| 10,428,120 B2 | 10/2019 | Kontermann et al. |
| 2005/0042664 A1 | 2/2005 | Wu et al. |
| 2005/0048617 A1 | 3/2005 | Wu et al. |
| 2005/0100543 A1 | 5/2005 | Hansen et al. |
| 2005/0175606 A1 | 8/2005 | Huang et al. |
| 2006/0046971 A1 | 3/2006 | Stuhler et al. |
| 2006/0121005 A1 | 6/2006 | Berenson et al. |
| 2006/0228364 A1 | 10/2006 | Dennis et al. |
| 2006/0252096 A1 | 11/2006 | Zha et al. |
| 2007/0014794 A1 | 1/2007 | Carter et al. |
| 2007/0178082 A1 | 8/2007 | Silence et al. |
| 2007/0269422 A1 | 11/2007 | Beirnaert et al. |
| 2008/0069772 A1 | 3/2008 | Stuhler et al. |
| 2008/0260757 A1 | 10/2008 | Holt et al. |
| 2009/0259026 A1 | 10/2009 | Tomlinson et al. |
| 2010/0122358 A1 | 5/2010 | Brueggemann et al. |
| 2010/0150918 A1 | 6/2010 | Kufer et al. |
| 2010/0166734 A1 | 7/2010 | Dolk |
| 2010/0189651 A1 | 7/2010 | Stagliano et al. |
| 2010/0189727 A1 | 7/2010 | Rodeck et al. |
| 2010/0266531 A1 | 10/2010 | Hsieh et al. |
| 2010/0291112 A1 | 11/2010 | Kellner et al. |
| 2010/0311119 A1 | 12/2010 | Hermans et al. |
| 2011/0129458 A1 | 6/2011 | Dolk et al. |
| 2011/0165621 A1 | 7/2011 | Dreier et al. |
| 2011/0262439 A1 | 10/2011 | Kufer et al. |
| 2011/0275787 A1 | 11/2011 | Kufer et al. |
| 2011/0313135 A1 | 12/2011 | Vanhove et al. |
| 2012/0039899 A1 | 2/2012 | Olsen et al. |
| 2012/0231024 A1 | 9/2012 | Elsaesser-Beile et al. |
| 2012/0328619 A1 | 12/2012 | Fey et al. |
| 2013/0017200 A1 | 1/2013 | Scheer et al. |
| 2013/0136744 A1 | 5/2013 | Bouche et al. |
| 2013/0266568 A1 | 10/2013 | Brinkmann et al. |
| 2013/0267686 A1 | 10/2013 | Brinkmann et al. |
| 2013/0273055 A1 | 10/2013 | Borges et al. |
| 2013/0330335 A1 | 12/2013 | Bremel et al. |
| 2014/0004121 A1 | 1/2014 | Fanslow, III et al. |
| 2014/0023664 A1 | 1/2014 | Lowman et al. |
| 2014/0045195 A1 | 2/2014 | Daugherty et al. |
| 2014/0073767 A1 | 3/2014 | Lee et al. |
| 2014/0088295 A1 | 3/2014 | Smith et al. |
| 2014/0205601 A1 | 7/2014 | Beirnaert et al. |
| 2014/0242075 A1 | 8/2014 | Parren et al. |
| 2014/0302037 A1 | 10/2014 | Borges et al. |
| 2014/0322218 A1 | 10/2014 | Xiao et al. |
| 2015/0037334 A1 | 2/2015 | Kufer et al. |
| 2015/0056206 A1 | 2/2015 | Zhou |
| 2015/0064169 A1 | 3/2015 | Wang et al. |
| 2015/0079088 A1 | 3/2015 | Lowman et al. |
| 2015/0079093 A1 | 3/2015 | Stuhler |
| 2015/0093336 A1 | 4/2015 | Van Ginderachter et al. |
| 2015/0174268 A1 | 6/2015 | Li et al. |
| 2015/0183875 A1 | 7/2015 | Cobbold et al. |
| 2015/0232557 A1 | 8/2015 | Tan et al. |
| 2015/0274836 A1 | 10/2015 | Ho et al. |
| 2015/0274844 A1 | 10/2015 | Blankenship et al. |
| 2016/0024174 A1 | 1/2016 | Odunsi et al. |
| 2016/0032011 A1 | 2/2016 | Zhang et al. |
| 2016/0032019 A1 | 2/2016 | Xiao et al. |
| 2016/0039942 A1 | 2/2016 | Cobbold et al. |
| 2016/0068605 A1 | 3/2016 | Nemeth et al. |
| 2016/0130331 A1 | 5/2016 | Stull et al. |
| 2016/0215063 A1 | 7/2016 | Bernett et al. |
| 2016/0251440 A1 | 9/2016 | Roobrouck et al. |
| 2016/0257721 A1 | 9/2016 | Lieber et al. |
| 2016/0319040 A1 | 11/2016 | Dreier et al. |
| 2016/0340444 A1 | 11/2016 | Baeuerle et al. |
| 2016/0355842 A1 | 12/2016 | Parks et al. |
| 2017/0029502 A1 | 2/2017 | Raum et al. |
| 2017/0152316 A1 | 6/2017 | Cobbold et al. |
| 2017/0204164 A1 | 7/2017 | Himmler et al. |
| 2017/0275373 A1 | 9/2017 | Kufer et al. |
| 2017/0298149 A1 | 10/2017 | Baeuerle et al. |
| 2017/0334997 A1 | 11/2017 | Dubridge et al. |
| 2017/0369563 A1 | 12/2017 | Dubridge et al. |
| 2018/0016323 A1 | 1/2018 | Brandenburg et al. |
| 2018/0134789 A1 | 5/2018 | Baeuerle et al. |
| 2018/0148508 A1 | 5/2018 | Wang et al. |
| 2018/0161428 A1 | 6/2018 | Dubridge et al. |
| 2018/0162949 A1 | 6/2018 | Baeuerle et al. |
| 2018/0326060 A1 | 11/2018 | Wesche et al. |
| 2018/0327508 A1 | 11/2018 | Wesche et al. |
| 2019/0031749 A1 | 1/2019 | Dubridge et al. |
| 2019/0092862 A1 | 3/2019 | Cui et al. |
| 2019/0225702 A1 | 7/2019 | Baeuerle et al. |
| 2020/0095340 A1 | 3/2020 | Wesche et al. |
| 2020/0115461 A1 | 4/2020 | Evnin et al. |
| 2020/0148771 A1 | 5/2020 | Paeuerle et al. |

FOREIGN PATENT DOCUMENTS

| | | |
|---|---|---|
| CN | 105968201 A | 9/2016 |
| CN | 105968204 A | 9/2016 |
| CN | 109593786 A | 4/2019 |
| EP | 0239400 A2 | 9/1987 |
| EP | 0519596 A1 | 12/1992 |
| EP | 0592106 A1 | 4/1994 |
| EP | 1378520 A1 | 1/2004 |
| EP | 1736484 A1 | 12/2006 |
| EP | 2336179 A1 | 6/2011 |
| FR | 901228 A | 7/1945 |
| JP | 2005501517 A | 1/2005 |
| WO | WO-9109967 A1 | 7/1991 |
| WO | WO-9307105 A1 | 4/1993 |
| WO | WO-9404678 A1 | 3/1994 |
| WO | WO-9937681 A2 | 7/1999 |
| WO | WO-0043507 A1 | 7/2000 |
| WO | WO-0190190 A2 | 11/2001 |
| WO | WO-0196584 A2 | 12/2001 |
| WO | WO-02085945 A2 | 10/2002 |
| WO | WO-03025020 A1 | 3/2003 |
| WO | WO-03035694 A2 | 5/2003 |
| WO | WO-03064606 A2 | 8/2003 |
| WO | WO-2004003019 A2 | 1/2004 |
| WO | WO-2004041867 A2 | 5/2004 |
| WO | WO-2004042404 A1 | 5/2004 |
| WO | WO-2004049794 A2 | 6/2004 |
| WO | WO-2006020258 A2 | 2/2006 |

(56) References Cited

FOREIGN PATENT DOCUMENTS

| | | |
|---|---|---|
| WO | WO-2006122787 A1 | 11/2006 |
| WO | WO-2007024715 A2 | 3/2007 |
| WO | WO-2007042261 A2 | 4/2007 |
| WO | WO-2007062466 A1 | 6/2007 |
| WO | WO-2007115230 A2 | 10/2007 |
| WO | WO-2008028977 A2 | 3/2008 |
| WO | WO-2009025846 A2 | 2/2009 |
| WO | WO-2009030285 A1 | 3/2009 |
| WO | WO-2009147248 A2 | 12/2009 |
| WO | WO-2010003118 A1 | 1/2010 |
| WO | WO-2010037836 A2 | 4/2010 |
| WO | WO-2010037837 A2 | 4/2010 |
| WO | WO-2011039368 A2 | 4/2011 |
| WO | WO-2011051327 A2 | 5/2011 |
| WO | WO-2012131053 A1 | 10/2012 |
| WO | WO-2012138475 A1 | 10/2012 |
| WO | WO-2012158818 A2 | 11/2012 |
| WO | WO-2012163805 A1 | 12/2012 |
| WO | WO-2012175400 A1 | 12/2012 |
| WO | WO-2013036130 A1 | 3/2013 |
| WO | WO-2013072406 A1 | 5/2013 |
| WO | WO-2013072415 A1 | 5/2013 |
| WO | WO-2013104804 A2 | 7/2013 |
| WO | WO-2013110531 A1 | 8/2013 |
| WO | WO-2013128027 A1 | 9/2013 |
| WO | WO-2014033304 A2 | 3/2014 |
| WO | WO-2014138306 A1 | 9/2014 |
| WO | WO-2014140358 A1 | 9/2014 |
| WO | WO-2014151910 A1 | 9/2014 |
| WO | WO-2015103072 A1 | 7/2015 |
| WO | WO-2015150447 A1 | 10/2015 |
| WO | WO-2015184207 A1 | 12/2015 |
| WO | WO-2016004677 A1 | 1/2016 |
| WO | WO-2016009029 A1 | 1/2016 |
| WO | WO-2016034044 A1 | 3/2016 |
| WO | WO-2016046778 A2 | 3/2016 |
| WO | WO-2016055551 A1 | 4/2016 |
| WO | WO-2016087531 A1 | 6/2016 |
| WO | WO-2016105450 A2 | 6/2016 |
| WO | WO-2016130819 A2 | 8/2016 |
| WO | WO-2016171999 A2 | 10/2016 |
| WO | WO-2016179003 A1 | 11/2016 |
| WO | WO-2016187101 A2 | 11/2016 |
| WO | WO-2016187594 A1 | 11/2016 |
| WO | WO-2016210447 A1 | 12/2016 |
| WO | WO-2017025698 A1 | 2/2017 |
| WO | WO-2017027392 A1 | 2/2017 |
| WO | WO-2017031104 A1 | 2/2017 |
| WO | WO-2017041749 A1 | 3/2017 |
| WO | WO-2017079528 A1 | 5/2017 |
| WO | WO-2017134134 A1 | 8/2017 |
| WO | WO-2017136549 A1 | 8/2017 |
| WO | WO-2017156178 A1 | 9/2017 |
| WO | WO-2017201488 A1 | 11/2017 |
| WO | WO-2017201493 A1 | 11/2017 |
| WO | WO-2018017863 A1 | 1/2018 |
| WO | WO-2018067993 A1 | 4/2018 |
| WO | WO-2018071777 A1 | 4/2018 |
| WO | WO-2018083204 A1 | 5/2018 |
| WO | WO-2018098354 A1 | 5/2018 |
| WO | WO-2018098356 A1 | 5/2018 |
| WO | WO-2018133877 A1 | 7/2018 |
| WO | WO-2018136725 A1 | 7/2018 |
| WO | WO-2018160671 A1 | 9/2018 |
| WO | WO-2018160754 A2 | 9/2018 |
| WO | WO-2018165619 A1 | 9/2018 |
| WO | WO-2018204717 A1 | 11/2018 |
| WO | WO-2018209298 A1 | 11/2018 |
| WO | WO-2018209304 A1 | 11/2018 |
| WO | WO-2018232020 A1 | 12/2018 |
| WO | WO-2019025983 A1 | 2/2019 |
| WO | WO-2019075359 A1 | 4/2019 |
| WO | WO-2019075378 A1 | 4/2019 |
| WO | WO-2019222278 A1 | 11/2019 |
| WO | WO-2019222282 A1 | 11/2019 |
| WO | WO-2019222283 A1 | 11/2019 |
| WO | WO-2019229701 A2 | 12/2019 |
| WO | WO-2020060593 A1 | 3/2020 |
| WO | WO-2020061482 A1 | 3/2020 |
| WO | WO-2020061526 A1 | 3/2020 |
| WO | WO-2020069028 A1 | 4/2020 |
| WO | WO-2020232303 A1 | 11/2020 |

OTHER PUBLICATIONS

Stork et al. (Protein Eng. Des. Sel. Nov. 2007; 20 (11): 569-76).*
Muller et al. (J. Biol. Chem. Apr. 27, 2007; 282 (17): 12650-60).*
Hopp et al. (Protein Eng. Des. Sel. Nov. 2010; 23 (11): 827-34).*
Spiess et al. (Mol. Immunol. Oct. 2015; 67 (2 Pt A): 95-106).*
Julian et al. (Sci. Rep. 2017; 7: 45259; pp. 1-13).*
Sheng et al. (Chem. Res. Toxicol. May 16, 2016; 29 (5): 797-809; author manuscript; published May 16, 2017; pp. 1-30).*
Stehle et al. (Anticancer Drugs. Sep. 1999; 10 (8): 785-90).*
Tiller et al. (Front. Immunol. Sep. 4, 2017; 8: 986; pp. 1-16).*
Rozan et al. Single-domain antibody-based and linker-free bispecific antibodies targeting FcγRIII induce potent antitumor activity without recruiting regulatory T cells. Mol Cancer Ther 12(8):1481-1491 (2013).
Schmidt et al. Cloning and Characterization of Canine Prostate-Specific Membrane Antigen. The Prostate 73:642-650 (2013).
U.S. Appl. No. 15/600,264 Office Action dated Apr. 25, 2019.
U.S. Appl. No. 15/821,498 Office Action dated May 3, 2019.
U.S. Appl. No. 15/821,530 Office Action dated Apr. 3, 2019.
U.S. Appl. No. 15/977,988 Office Action dated Mar. 26, 2019.
Almagro et al. Humanization of antibodies. Front Biosci 13:1619-1633 (2008).
Argani et al. Mesothelin is overexpressed in the vast majority of ductal adenocarcinomas of the pancreas: identification of a new pancreatic cancer marker by serial analysis of gene expression (SAGE). Clin Cancer Res 7(12):3862-3868 (2001).
Baca et al. Antibody humanization using monovalent phage display. J Biol Chem 272(16):10678-10684 (1997).
Baeuerle et al. Bispecific T-cell engaging antibodies for cancer therapy. Cancer Res 69:4941-4944 (2009).
Bedouelle et al. Diversity and junction residues as hotspots of binding energy in an antibody neutralizing the dengue virus. FEBS J 273(1):34-46 (2006).
Bortoletto et al. Optimizing anti-CD3 affinity for effective T cell targeting against tumor cells. Eur J Immunol 32:3102-3107 (2002).
Bracci et al. Cyclophosphamide enhances the antitumor efficacy of adoptively transferred immune cells through the induction of cytokine expression, B-cell and T-cell homeostatic proliferation, and specific tumor infiltration. Clin Cancer Res 13(2 Pt 1):644-653 (2007).
Brown et al. Tolerance of single, but not multiple, amino acid replacements in antibody VH CDR 2: a means of minimizing B cell wastage from somatic hypermutation? J Immunol 156(9):3285-3291 (1996).
Caldas et al. Humanization of the anti-CD18 antibody 6.7: an unexpected effect of a framework residue in binding to antigen. Mol Immunol. 39(15):941-952 (2003).
Carter et al. Humanization of an anti-p185HER2 antibody for human cancer therapy. PNAS USA 89(10):4285-4289 (1992).
Casset et al. A peptide mimetic of an anti-CD4 monoclonal antibody by rational design. Biochemical and Biophysical Research Communication 307:198-205 (2003).
Chang et al. Loop-sequence features and stability determinants in antibody variable domains by high-throughput experiments. Structure 22(1):9-21 (2014).
Chang et al. Molecular cloning of mesothelin, a differentiation antigen present on mesothelium, mesotheliomas, and ovarian cancers. PNAS USA 93:136-140 (1996).
Chatalic et al. A Novel 111 In-labeled Anti-PSMA Nanobody for Targeted SPECT/CT Imaging of Prostate Cancer. J Nucl Med 56(7):1094-1099 and Supplemental Data (2015).
Chen et al. Selection and analysis of an optimized anti-VEGF antibody: Crystal structure of an affinity-matured Fab in complex with antigen. J Mol Bio 293:865-881 (1999).

(56) References Cited

OTHER PUBLICATIONS

Chien et al. Significant structural and functional change of an antigen-binding site by a distant amino acid substitution: proposal of a structural mechanism. PNAS USA 86(14):5532-5536 (1989).
Chothia et al. Canonical structures for the hypervariable regions of immunoglobulins. J Mol Biol 196(4):901-917 (1987).
Corso et al. Real-time detection of mesothelin in pancreatic cancer cell line supernatant using an acoustic wave immunosensor. Cancer Detect Prey 30:180-187 (2006).
Creaney et al. Detection of malignant mesothelioma in asbestos-exposed individuals: the potential role of soluble mesothelin-related protein. Hematol. Oncol. Clin. North Am. 19:1025-1040 (2005).
Cristaudo et al. Clinical significance of serum mesothelin in patients with mesothelioma and lung cancer. Clin. Cancer Res. 13:5076-5081 (2007).
De Pascalis et al. Grafting of "abbreviated" complementarity-determining regions containing specificity-determining residues essential for ligand contact to engineer a less immunogenic humanized monoclonal antibody. J Immunol. 169(6):3076-3084 (2002).
Document D28—Investigation of human CD3ε variants binding to monoclonal antibodies. Submitted by Pfizer to the European Patent Register on Apr. 30, 2014 in connection with their opposition to the EP2155783 patent. (3 pages) (2014).
Document D78—CD3ε N-terminal peptide bound to the CDRs of SP24. Submitted by Janssen Biotech to the European Patent Register on Mar. 18, 2016 in connection with their opposition to the EP2155783 patent (1 page) (2016).
Document D79—Interactions between CD3ε and SP34 CDR residues. CD3ε residues are in ellipses, SP34 CDR residues are in boxes. Submitted by Janssen Biotech to the European Patent Register on Mar. 18, 2016 in connection with their opposition to the EP2155783 patent (1 page) (2016).
Document D83—Alignment of variable domains from the prior art and the patent. Submitted by Janssen Biotech to the European Patent Register on Mar. 18, 2016 in connection with their opposition to the EP2155783 patent (1 page) (2016).
Foote et al. Antibody Framework Residues Affecting the Conformation of the Hypervariable Loops. J. Mol. Biol. 224(2):487-99 (1992).
Frankel et al. Targeting T cells to tumor cells using bispecific antibodies. Curr Opin Chem Biol 17(3):385-392 (2013).
Giusti et al. Somatic diversification of S107 from an antiphosphocholine to an anti-DNA autoantibody is due to a single base change in its heavy chain variable region. PNAS USA 84(9):2926-30 (1987).
Goldman et al. Enhancing Stability of Camelid and Shark Single Domain Antibodies: An Overview. Front. Immunol. 8:865 (2017).
Goodman et al. The Pharmaceutical Basis of Therapeutics. 6th ed. pp. 21-25 (1980).
Goswami et al. Developments and Challenges for mAb-Based Therapeutics. Antibodies 2:452-500 (2013).
Gross et al. Endowing T cells with antibody specificity using chimeric T cell receptors. FASEB J. 6(15):3370-3378 (1992).
Gubbels et al. Mesothelin-MUC16 binding is a high affinity, N-glycan dependent interaction that facilitates peritoneal metastasis of ovarian tumors. Mol Cancer 5:50 (2006).
Gussow et al. Chapter 5: Humanization of Monoclonal Antibodies. Methods in Enzymology 203:99-121 (1991).
Harding et al. The immunogenicity of humanized and fully human antibodies: residual immunogenicity resides in the CDR regions. MAbs 2(3):256-265 (2010).
Hassan et al. Detection and quantitation of serum mesothelin, a tumor marker for patients with mesothelioma and ovarian cancer. Clin Cancer Res 12:447-453 (2006).
Hassan et al. Mesothelin: a new target for immunotherapy. Clin Cancer Res 10:3937-3942 (2004).
Hassan et al. Mesothelin targeted cancer immunotherapy. Eur J Cancer 44:46-53 (2008).
Hassan et al. Phase I study of SS1P, a recombinant anti-mesothelin immunotoxin given as a bolus I.V. infusion to patients with mesothelin-expressing mesothelioma, ovarian, and pancreatic cancers. Clin Cancer Res 13(17):5144-5149 (2007).
Hassan et al. Preclinical evaluation of MORAb-009, a chimeric antibody targeting tumor-associated mesothelin. Cancer Immun. 7:20 (2007).
Hellstrom et al. Mesothelin variant 1 is released from tumor cells as a diagnostic marker. Cancer Epidemiol Biomarkers Prey 15:1014-1020 (2006).
Ho et al. A novel high-affinity human monoclonal antibody to mesothelin. Int J Cancer 128:2020-2030 (2011).
Ho et al. Mesothelin expression in human lung cancer. Clin Cancer Res 13:1571-1575 (2007).
Holm et al. Functional mapping and single chain construction of the anti-cytokeratin 8 monoclonal antibody TS1. Mol Immunol 44(6):1075-1084 (2007).
Holt et al. Anti-serum albumin domain antibodies for extending the half-lives of short lived drugs. Protien Eng Des Sel 21(5):283-288 (2008).
Hutchinson et al. Mutagenesis at a specific position in a DNA sequence. J Biol Chem 253:6551-6560 (1978).
Janssen letter—Submission under Rule 116 EPC. Submitted by Janssen Biotech to the European Patent Register on Mar. 18, 2016 in connection with their opposition to the EP2155783 patent (6 pages) (2016).
Kabat et al. Identical V region amino acid sequences and segments of sequences in antibodies of different specificities. Relative contributions of VH and VL genes, minigenes, and complementarity-determining regions to binding of antibody-combining sites. J Immunol 147:1709-1719 (1991).
Kojima et al. Molecular cloning and expression of megakaryocyte potentiating factor cDNA. J Biol Chem 270:21984-21990 (1995).
Le Gall et al. Immunosuppressive properties of anti-CD3 single-chain Fv and diabody. J Immunol Methods 285(1):111-127 (2004).
Li et al. Development of novel tetravalent anti-CD20 antibodies with potent antitumor activity. Cancer Res 68:2400-2408 (2008).
Liu et al. A New Format of Single Chain Tri-specific Antibody with Diminished Molecular Size Efficiently Induces Ovarian Tumor Cell Killing. Biotechnology Letters 27(22):1821-1827 (2005).
Liu et al. MGD011, a CD19 x CD3 Dual Affinity Re-Targeting Bi-specific Molecule Incorporating Extended Circulating Half-life for the Treatment of B-cell Malignancies. Clin Cancer Res 23(6):1506-1518 (epub 2016) (2017).
Lutterbuese et al. T cell-engaging BiTE antibodies specific for EGFR potently eliminate KRAS- and BRAF-mutated colorectal cancer cells. PNAS 107:12605-12610 (2007).
Maccallum et al. Antibody-antigen interactions: contact analysis and binding site topography. J Mol Biol. 262(5):732-745 (1996).
Mariuzza et al. The structural basis of antigen-antibody recognition. Annu Rev Biophys Biophys Chem 16:139-159 (1987).
Mirsky et al. Antibody-Specific Model of Amino Acid Substitution for Immunological Inferences from Alignments of Antibody Sequences. Mol. Biol. Evol. 32(3):806-819 (2014).
Morea et al. Antibody modeling: implications for engineering and design. Methods 20(3):267-279 (2000).
Moschella et al. Unraveling cancer chemoimmunotherapy mechanisms by gene and protein expression profiling of responses to cyclophosphamide. Cancer Res 71(10):3528-3539 (2011).
Mueller et al. Improved pharmacokinetics of recombinant bispecific antibody molecules by fusion to human serum albumin. J Bio Chem 282(17):12650-12660 (2007).
Muller et al. Improving the pharmacokinetic properties of biologics by fusion to an anti-HSA shark VNAR domain. MAbs 4(6):673-685 (2012).
Muul et al. Persistence and expression of the adenosine deaminase gene for 12 years and immune reaction to gene transfer components: long-term results of the first clinical gene therapy trial. Blood 101(7):2563-2569 (2003).
Nazarian et al. Characterization of bispecific T-cell Engager (BiTE) antibodies with a high-capacity T-cell dependent cellular cytotoxicity (TDCC) assay. J Biomol Screen 20:519-527 (2015).
Nelson et al. Antibody fragments Hope and Hype. mAbs 2(1):77-83 (2010).

(56) References Cited

OTHER PUBLICATIONS

Nunez-Prado et al. The coming of age of engineered multivalent antibodies. Drug Discovery Today 20(5):588-594 (2015).
Ohiro et al. A homogeneous and noncompetitive immunoassay based on the enhanced fluorescence resonance energy transfer by leucine zipper interaction. Anal Chem 74(22):5786-5792 (2002).
O'Keefe et al. Chapter 18: Prostate specific membrane antigen. In: Chung L.W.K., Isaacs W.B., Simons J.W. (eds) Prostate Cancer. Contemporary Cancer Research. Humana Press, Totowa, NJ (pp. 307-326) (2001).
Ordonez. Application of mesothelin immunostaining in tumor diagnosis. Am J Surg Pathol 27:1418-1428 (2003).
Padlan. Anatomy Of The Antibody Molecule. Mol Immunol 31(3):169-217 (1994).
Padlan et al. Structure of an antibody-antigen complex: Crystal structure of the HyHEL-10 Fab-lysozyme complex. PNAS USA 86:5938-5942 (1989).
Pawluczkowycz et al. Binding of submaximal C1q promotes complement-dependent cytotoxicity (CDC) of B cells opsonized with anti-CD20 mAbs ofatumumab (OFA) or rituximab (RTX): considerably higher levels of CDC are induced by OFA than by RTX. J Immunol 183:749-758 (2009).
PCT/US2016/033644 International Preliminary Report on Patentability dated Nov. 30, 2017.
PCT/US2016/033644 International Search Report and Written Opinion dated Sep. 6, 2016.
PCT/US2017/033665 International Search Report and Written Opinion dated Oct. 18, 2017.
PCT/US2017/033673 International Search Report and Written Opinion dated Oct. 18, 2017.
PCT/US2017056530 International Search Report and Written Opinion dated Jan. 23, 2018.
PCT/US2017/063121 International Search Report and Written Opinion dated Mar. 26, 2018.
PCT/US2017/063121 Invitation to Pay Additional Fees dated Feb. 1, 2018.
PCT/US2017/063126 International Search Report and Written Opinion dated Apr. 5, 2018.
PCT/US2017/063126 Invitation to Pay Additional Fees dated Feb. 1, 2018.
PCT/US2018/020185 International Search Report and Written Opinion dated Jun. 15, 2018.
PCT/US2018/020307 International Search Report and Written Opinion dated Aug. 24, 2018.
PCT/US2018/030983 International Search Report and Written Opinion dated Sep. 25, 2018.
PCT/US2018/030983 Invitation to Pay Additional Fees dated Jul. 31, 2018.
PCT/US2018/032418 International Search Report and Written Opinion dated Sep. 24, 2018.
PCT/US2018/032427 International Search Report and Written Opinion dated Sep. 13, 2018.
PCT/US2018/32418 Invitation to Pay Additional Fees dated Jul. 23, 2018.
PCT/US2018/32427 Invitation to Pay Additional Fees dated Jul. 24, 2018.
Pfizer letter—Opposition to European Patent EP2155783 (Application 08735001.3). Submitted by Pfizer to the European Patent Register on Apr. 30, 2014 in connection with their opposition to the EP2155783 patent. (pp. 1-23 and Appendix 1 on pp. 24-26) (2014).
Presta et al. Humanization of an antibody directed against IgE. J Immunol 151:2623-2632 (1993).
Riechmann et al. Single domain antibodies: comparison of camel VH and camelised human VH domains. J Immunol Methods 231(1-2):25-38 (1999).
Rosok et al. A Combinatorial Library Strategy for the Rapid Humanization of Anticarcinoma BR96 Fab. J Biol Chem 271:22611-22618 (1996).
Rudikoff et al. Single amino acid substitution altering antigen-binding Specificity. PNAS USA 79:1979-1983 (1982).
Rump et al. Binding of ovarian cancer antigen CA125/MUC16 to mesothelin mediates cell adhesion. J Biol Chem 279:9190-9198 (2004).
Running Deer et al. High-level expression of proteins in mammalian cells using transcription regulatory sequences from the Chinese hamster EF-1alpha gene. Biotechnol Prog. 20:880-889 (2004).
Sadelain et al. Targeting tumours with genetically enhanced T lymphocytes. Nat Rev Cancer 3(1):35-45 (2003).
Saerens et al. Identification of a universal VHH framework to graft non-canonical antigen-binding loops of camel single-domain antibodies. J. Mol. Biol. 352(3):597-607 (2005).
Schmittgen et al. Expression of prostate specific membrane antigen and three alternatively spliced variants of PSMA in prostate cancer patients. Int J Cancer 107:323-329 (2003).
Sims et al. A humanized CD18 antibody can block function without cell destruction. J Immunol., 151 (1993): 2296-2308.
Su et al. PSMA specific single chain antibody-mediated targeted knockdown of Notch1 inhibits human prostate cancer cell proliferation and tumor growth. Cancer Lett. 338 (2): 282-291 (2013).
Tang et al. A human single-domain antibody elicits potent antitumor activity by targeting an epitope in mesothelin close to the cancer cell surface. Mol. Cancer Thera 12(4):416-426 (2013).
Thomas et al. Mesothelin-specific CD8(+) T cell responses provide evidence of in vivo cross-priming by antigen-presenting cells in vaccinated pancreatic cancer patients. J Exp Med 200:297-306 (2004).
Tiller et al. Facile Affinity Maturation of Antibody Variable Domains Using Natural Diversity Mutagenesis. Front. Immunol. 8:986 (2017).
Tutt et al. Trispecific F(Ab')3 Derivatives That Use Cooperative Signaling Via The Tcr/Cd3 Complex And Cd2 To Activate And Redirect Resting Cytotoxic T Cells. J Immunol 147(1):60-69 (1991).
U.S. Appl. No. 15/160,984 Office Action dated Feb. 24, 2017.
U.S. Appl. No. 15/160,984 Office Action dated Sep. 22, 2016.
U.S. Appl. No. 15/600,264 Office Action dated Apr. 26, 2018.
U.S. Appl. No. 15/600,264 Office Action dated Nov. 27, 2018.
U.S. Appl. No. 15/600,264 Office Action dated Oct. 3, 2017.
U.S. Appl. No. 15/600,582 Office Action dated Nov. 16, 2017.
U.S. Appl. No. 15/704,620 Office Action dated Oct. 26, 2017.
U.S. Appl. No. 15/821,498 Office Action dated Oct. 26, 2018.
U.S. Appl. No. 15/821,530 Office Action dated Sep. 25, 2018.
Vajdos et al. Comprehensive functional maps of the antigen-binding site of an anti-ErbB2 antibody obtained with shotgun scanning mutagenesis. J Mol Biol 320:415-428 (2002).
Van Den Beuchken et al. Building novel binding ligands to B7.1 and B7.2 based on human antibody single variable light chain domains. J Mol biol 310:591-601 (2001).
Vaughan et al. Human antibodies by design. Nature Biotech 16:535-539 (1998).
Vincke et al. General strategy to humanize a camelid single-domain antibody and identification of a universal humanized nanobody scaffold. J. Biol. Chem. 284(5):3273-3284 (2009).
Wang et al. A New Recombinant Single Chain Trispecific Antibody Recruits T Lymphocytes to Kill CEA (Carcinoma Embryonic Antigen) Positive Tumor Cells In Vitro Efficiently. Journal Of Biochemistry 135(4):555-565 (2004).
Winkler et al. Changing the antigen binding specificity by single point mutations of an anti-p24 (HIV-1) antibody. J Immunol. 165(8):4505-4514 (2000).
Wu et al. Humanization of a murine monoclonal antibody by simultaneous optimization of framework and CDR residues. J.Mol. Biol. 294:151-162 (1999).
Yee et al. Adoptive T cell therapy using antigen-specific CD8+ T cell clones for the treatment of patients with metastatic melanoma: in vivo persistence, migration, and antitumor effect of transferred T cells. PNAS USA 99(25):16168-16173 (2002).
Yu et al. Rationalization and design of the complementarity determining region sequences in an antibody-antigen recognition interface. PLoS One 7(3):e33340 (2012).
Zare et al. Production of nanobodies against prostate-specific membrane antigen (PSMA) recognizing LnCaP cells. Int. J. Biol. Markers 29(2):e169-e179 (2014).
Zhu et al. Combody: one-domain antibody multimer with improved avidity. Immunology And Cell Biology 88(6):667-675 (2010).

(56) References Cited

OTHER PUBLICATIONS

Austin et al. Cancer Research (Jul. 2018) vol. 78, No. 13, Supp. Supplement 1. Abstract No. 1781. Meeting Info: 2018 Annual Meeting of the American Association for Cancer Research, AACR 2018. Chicago, IL, United States. Apr. 14, 2018-Apr. 18, 2018).
Cho et al. Targeting B Cell Matruration Antigen (BCMA) in Multiple Myeloma: Potential Uses of BCMA-Based Immunotherapy. Front Immunol 9:1821 (2018).
Co-pending U.S. Appl. No. 16/159,545, filed Oct. 12, 2018.
Lu et al. In vitro and in vivo antitumor effect of a trivalent bispecific antibody targeting ErbB2 and CD16. Cancer Biol Ther. 7(11):1744-1750 (2008).
PCT/US2018/014396 International Search Report and Written Opinion dated Jun. 14, 2018.
PCT/US2018/055659 International Search Report and Written Opinion dated Feb. 21, 2019.
PCT/US2018/055659 Invitation to Pay Additional Fees dated Dec. 19, 2018.
PCT/US2018/055682 International Search Report and Written Opinion dated Mar. 1, 2019.
PCT/US2018/055682 Invitation to Pay Additional Fees dated Jan. 8, 2019.
Sternjak et al. Cancer Research, (Jul. 2017) vol. 77, No. 13, Supp. Supplement 1. Abstract No. 3630. Meeting Info: American Association for Cancer Research Annual Meeting 2017. Washington, DC, United States. Apr. 1, 2017-Apr. 5, 2017.
U.S. Appl. No. 15/977,968 Office Action dated Feb. 21, 2019.
U.S. Appl. No. 15/977,988 Preinterview First Office Action dated Jan. 25, 2019.
Muyldermans. Nanobodies: natural single-domain antibodies. Annu Rev Biochem, 82:775-797, 2013.
PCT/US2018/014396 International Preliminary Report on Patentability dated Aug. 1, 2019.
PCT/US2019/032224 International Search Report and Written Opinion dated Aug. 28, 2019.
PCT/US2019/032302 International Search Report and Written Opinion dated Aug. 22, 2019.
PCT/US2019/032306 International Search Report and Written Opinion dated Aug. 22, 2019.
PCT/US2019/032307 International Search Report and Written Opinion dated Aug. 22, 2019.
U.S. Appl. No. 15/977,988 Office Action dated Aug. 20, 2019.
U.S. Appl. No. 16/159,545 Office Action dated Aug. 6, 2019.
Co-pending U.S. Appl. No. 16/773,806, filed Jan. 27, 2020.
Co-pending U.S. Appl. No. 16/773,843, filed Jan. 27, 2020.
Co-pending U.S. Appl. No. 16/802,007, filed Feb. 26, 2020.
Zhang et al. New High Affinity Monoclonal Antibodies Recognize Non-Overlapping Epitopes On Mesothelin For Monitoring And Treating Mesothelioma. Sci Rep 5:9928 (2015).
Baum et al. Antitumor activities of PSMAxCD3 diabodies by redirected T-cell lysis of prostate cancer cells. Immunotherapy 5(1):27-38 (2013).
Harmsen et al. Properties, production, and applications of camelid single-domain antibody fragments. Appl. Microbiol. Biotechnol. 77:13-22 (2007).
PCT/US2019/052206 International Search Report and Written Opinion dated Feb. 14, 2020.
PCT/US2019/052270 International Search Report and Written Opinion dated Mar. 5, 2020.
PCT/US2019/053017 International Search Report and Written Opinion dated Jan. 31, 2020.
U.S. Appl. No. 15/821,498 Office Action dated Apr. 21, 2020.
U.S. Appl. No. 15/821,530 Office Action dated Apr. 22, 2020.
U.S. Appl. No. 16/583,070 Office Action dated Mar. 3, 2020.
Zabetakis et al. Contributions of the complementarity determining regions to the thermal stability of a single-domain antibody. PLoS One 8(10):e77678 (2013).
Agata et al. Expression of the PD-1 antigen on the surface of stimulated mouse T and B lymphocytes. Int. Immunol 8:765-75 (1996).

Al-Lazikani et al. Standard conformations for the canonical structures of immunoglobulins. J. Mol Biology 273(4):927-948 (1997).
Altschul et al. Basic local alignment search tool. J Mol Biol 215(3):403-410 (1990).
Altschul, et al. Gapped BLAST and PSI-BLAST: a new generation of protein database search programs. Nucleic Acids Res 25:3389-3402 (1977).
Barrett et al. Treatment of advanced leukemia in mice with mRNA engineered T cells. Hum Gene Ther 22:1575-1586 (2011).
Batzer et al. Enhanced evolutionary PCR using oligonucleotides with inosine at the 3'-terminus. Nucleic Acids Res. 19(18):5081 (1991).
Bird et al. Single-chain antigen-binding proteins. Science 242(4877):423-426 (1988).
Blank et al. Interaction of PD-L1 on tumor cells with PD-1 on tumor-specific T cells as a mechanism of immune evasion: implications for tumor immunotherapy. Cancer Immunol Immunother 54:307-314 (2005).
Caldas et al. Design and synthesis of germline-based hemi-humanized single-chain Fv against the CD18 surface antigen. Protein Eng 13(5):353-360 (2000).
Carter et al. PD-1: PD-L inhibitory pathway affects both CD4(+) and CD8(+) T cells and is overcome by IL-2. Eur J Immunol 32:634-643 (2002).
Choi et al. Engineering of Immunoglobulin Fc heterodimers using yeast surface-displayed combinatorial Fc library screening. PLOS One 10(12):e0145349 (2015).
Chothia, et al. Conformations of immunoglobulin hypervariable regions. Nature 342(6252):877-83 (1989).
Cougot et al. 'Cap-tabolism'. Trends in Biochem Sci 29:436-444 (2001).
Couto et al. Anti-BA46 monoclonal antibody Mc3: humanization using a novel positional consensus and in vivo and in vitro characterization. Cancer Res 55(8):1717-1722 (1995).
Couto et al. Designing human consensus antibodies with minimal positional templates. Cancer Res 55(23 Supp):5973s-5977s (1995).
Dao et al. Targeting the intracellular WT1 oncogene product with a therapeutic human antibody. Sci Transl Med 5(176):176ra33 (2013).
De Genst et al. Antibody repertoire development in camelids. Dev Comp Immunol 30(1-2):187-198 (2006).
Dong et al. B7-H1 pathway and its role in the evasion of tumor immunity. J Mol Med 81:281-287 (2003).
Elango et al. Optimized transfection of mRNA transcribed from a d(A/T)100 tail-containing vector. Biochim Biophys Res Commun 330:958-966 (2005).
Freeman et al. Engagement of the PD-1 immunoinhibitory receptor by a novel B7 family member leads to negative regulation of lymphocyte activation. J Exp Med 192:1027-1034 (2000).
Garland et al. The use of Teflon cell culture bags to expand functionally active CD8+ cytotoxic T lymphocytes. J Immunol Meth 227(1-2):53-63 (1999).
Grupp et al. Chimeric antigen receptor-modified T cells for acute lymphoid leukemia. NEJM 368:1509-1518 (2013).
Haanen et al. Selective expansion of cross-reactive CD8(+) memory T cells by viral variants. J Exp Med 190(9):1319-1328 (1999).
Ho et al. Mesothelin is shed from tumor cells. Cancer Epidemiol Biomarkers Prev 15:1751 (2006).
Hollinger et al. "Diabodies": Small bivalent and bispecific antibody fragments . PNAS USA 90:6444 6448 (1993).
Huston et al. Protein engineering of antibody binding sites: recovery of specific activity in an anti-digoxin single-chain Fv analogue produced in *Escherichia coli*. PNAS USA 85(16):5879-5883 (1988).
Izumoto et al. Phase II clinical trial of Wilms tumor 1 peptide vaccination for patients with recurrent glioblastoma multiforme. J Neurosurg 108:963-971 (2008).
Jones et al. Replacing the complementarity-determining regions in a human antibody with those from a mouse. Nature 321:522-525 (1986).
Kabat et al. Sequences of proteins of immunological interest. NIH Publ. No. 91-3242 1:647-669 (1991).
Kalos et al. T cells with chimeric antigen receptors have potent antitumor effects and can establish memory in patients with advanced leukemia. Sci Transl Med 3(95):95ra73 (2011).

(56) References Cited

OTHER PUBLICATIONS

Konishi et al. B7-H1 expression on non-small cell lung cancer cells and its relationship with tumor-infiltrating lymphocytes and their PD-1 expression. Clin Cancer Res 10:5094-5100 (2004).
Latchman et al. PD-L2 is a second ligand for PD-1 and inhibits T cell activation. Nat Immunol 2:261-268 (2001).
Lowman et al. Monovalent phage display: A method for selecting variant proteins from random libraries. Methods 3:205-216 (1991).
Milone et al. Chimeric receptors containing CD137 signal transduction domains mediate enhanced survival of T cells and increased antileukemic efficacy in vivo. Mol Ther 17(8):1453-1464 (2009).
Mumtaz et al. Design of liposomes for circumventing the reticuloendothelial cells. Glycobiology 5:505-10 (1991).
Nacheva et al. Preventing nondesired RNA-primed RNA extension catalyzed by T7 RNA polymerase. Eur J Biochem 270:1458-1465 (2003).
Needleman et al. A general method applicable to the search for similarities in the amino acid sequence of two proteins. J. Mol. Biol. 48:443-453 (1970).
Nicholson et al. Construction and characterisation of a functional CD19 specific single chain Fv fragment for immunotherapy of B lineage leukaemia and lymphoma. Mol Immun 34(16-17):1157-1165 (1997).
Nishikawa et al. Nonviral vectors in the new millennium: delivery barriers in gene transfer. Human Gene Therapy. 12:861-870 (2001).
Ohtsuka et al. An alternative approach to deoxyoligonucleotides as hybridization probes by insertion of Deoxyinosine at Ambiguous Codon Positions. J Biol Chem 260(5):2605-2608 (Mar. 10, 1985).
Padlan. A possible procedure for reducing the immunogenicity of antibody variable domains while preserving their ligand-binding properties. Mol Immunol 28(4-5):489-498 (1991).
PCT/US2019/052206 Invitation to Pay Additional Fees dated Dec. 23, 2019.
PCT/US2019/052270 Invitation to Pay Additional Fees dated Jan. 9, 2020.
PCT/US2019/053017 Invitation to Pay Additional Fees dated Nov. 27, 2019.
Pearson, et al. Improved Tools for Biological Sequence Comparison. Proc. Nat'l Acad. Sci. USA. 85 (1988): 2444-48.
Pedersen et al. Comparison of surface accessible residues in human and murine immunoglobulin Fv domains. Implication for humanization of murine antibodies. J Mol Biol 235(3):959-973 (1994).
Porter et al. Chimeric antigen receptor T cells persist and induce sustained remissions in relapsed refractory chronic lymphocytic leukemia. Sci Trans Med 7(303):303ra319 (2015).
Porter et al. Chimeric antigen receptor-modified T cells in chronic lymphoid leukemia. NEJM 365:725-733 (2011).
Presta. Antibody Engineering. Curr Op Struct Biol 2:593-596 (1992).
Riechmann et al. Reshaping human antibodies for therapy. Nature, 332.6162:323-7 (1988).
Roguska et al. A comparison of two murine monoclonal antibodies humanized by CDR-grafting and variable domain resurfacing. Protein Eng 9(10):895-904 (1996).
Roguska et al. Humanization of murine monoclonal antibodies through variable domain resurfacing. PNAS 91:969-973 (1994).
Rosenberg et al. Use of tumor-infiltrating lymphocytes and interleukin-2 in the immunotherapy of patients with metastatic melanoma. A preliminary report. NEJM 319:1676 (1988).
Rossolini et al. Use of deoxyinosine-containing primers vs degenerate primers for polymerase chain reaction based on ambiguous sequence information. Mol Cell Probes 8(2):91-98 (1994).
Sadelain et al. The basic principles of chimeric antigen receptor design. Cancer Discov. 3(4):388-98 (2013).
Sandhu. A rapid procedure for the humanization of monoclonal antibodies. Gene 150(2):409-410 (1994).
Sastry et al. Targeting hepatitis B virus-infected cells with a T-cell receptor-like antibody. J Virol 85(5):1935-1942 (2011).
Schenborn et al. A novel transcription property of SP6 and T7 RNA polymerases: dependence on template structure. Nuc Acids Res 13:6223-6236 (1985).
Scheraga. Predicting three-dimensional structures of oligopeptides. Rev Computational Chem 3:73-142 (1992).
Sergeeva et al. An anti-PR1/HLA-A2 T-cell receptor-like antibody mediates complement-dependent cytotoxicity against acute myeloid leukemia progenitor cells. Blood 117(16):4262-4272 (2011).
Smith et al. Comparison of Biosequences. Advances in Applied Mathematics. 2:482-489 (1981).
Song et al. CD27 costimulation augments the survival and antitumor activity of redirected human T cells in vivo. Blood 119(3):696-706 (2012).
Stepinski et al. Synthesis and properties of mRNAs containing the novel 'anti-reverse' cap analogs 7-methyl(3'0-methyl)GpppG and 7-methyl(e'-deoxy)GpppG. RNA 7:1486-1495 (2001).
Strop. Veracity of microbial transglutaminase. Bioconjugate Chem. 25(5):855-862 (2014).
Studnicka et al. Human-engineered monoclonal antibodies retain full specific binding activity by preserving non-CDR complementarity-modulating residues. Pro Eng 7(6):805-814 (1994).
Tan et al. "Superhumanized" antibodies: reduction of immunogenic potential by complementarity-determining region grafting with human germline sequences: application to an anti-CD28. J Immunol 169:1119-1125 (2002).
Tassev et al. Retargeting NK92 cells using an HLA-A2-restricted, EBNA3C-specific chimeric antigen receptor. Cancer Gene Ther 19(2):84-100 (2012).
Ten Berg et al. Selective expansion of a peripheral blood CD8+ memory T cell subset expressing both granzyme B and L-selectin during primary viral infection in renal allograft recipients. Transplant Proc 30(8):3975-3977 (1998).
Ui-Tei et al. Sensitive assay of RNA interference in *Drosophila* and Chinese hamster cultured cells using firefly luciferase gene as target. FEBS Letters 479: 79-82 (2000).
U.S. Appl. No. 15/630,259 Office Action dated Dec. 30, 2019.
U.S. Appl. No. 16/159,545 Office Action dated Dec. 2, 2019.
Van Der Linden et al. Induction of immune responses and molecular cloning of the heavy chain antibody repertoire of Lama glama. J Immunol Methods 240:185-195 (2000).
Verhoeyen et al. Reshaping human antibodies: Grafting an antilysozyme activity. Science 239:1534-1536 (1988).
Verma et al. TCR mimic monoclonal antibody targets a specific peptide/HLA class I complex and significantly impedes tumor growth in vivo using breast cancer models. J Immunol 184(4):2156-2165 (2010).
Willemsen et al. A phage display selected fab fragment with MHC class I-restricted specificity for MAGE-A1 allows for retargeting of primary human T lymphocytes. Gene Ther 8(21):1601-1608 (2001).
Yan et al. Engineering upper hinge improves stability and effector function of a human IgG1. J. Biol. Chem. 287:5891 (2012).
Yoshinaga et al. Ig L-chain shuffling for affinity maturation of phage library-derived human anti-human MCP-1 antibody blocking its chemotactic activity. J Biochem 143(5):593-601 (2008).
Bendell et al. Abstract 5552: First-in-human phase I study of HPN424, a tri-specific half-life extended PSMA-targeting T-cell engager in patients with metastatic castration-resistant prostate cancer (mCRPC). J Clin Oncol 38(15):5552 (May 2020).
PCT/US/2020/032985 International Search Report and Written Opinion dated Oct. 15, 2020.
U.S. Appl. No. 15/630,259 Office Action dated Sep. 30, 2020.
Co-pending U.S. Appl. No. 16/999,773, inventors Wesche; Holger et al., filed Aug. 21, 2020.
Co-pending U.S. Appl. No. 17/030,118, inventors Dubridge; Robert et al., filed Sep. 23, 2020.
Co-pending U.S. Appl. No. 17/072,370, inventors Baeuerle; Patrick et al., filed Oct. 16, 2020.
Hassanzadeh-Ghassabeh et al. Nanobodies and their potential applications. Nanomedicine 8(6):1013-1026 (2013).

* cited by examiner

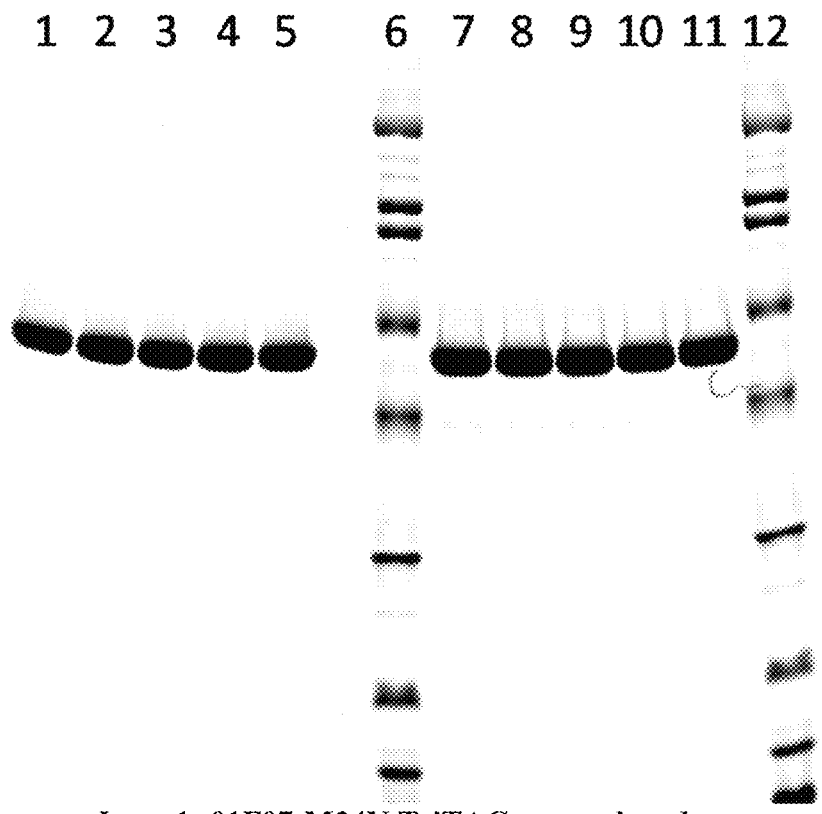

FIG. 3

SDS-PAGE OF PURIFIED BCMA TARGETING TRISPECIFIC PROTEINS

Lane 1: 01F07-M34Y TriTAC non-reduced
Lane 2: 01F07-M34G-TriTAC non-reduced
Lane 3: 02B05 TriTAC non-reduced
Lane 4: 02G02-M34Y TriTAC non-reduced
Lane 5: 02G02 M34G TriTAC non-reduced
Lane 6: Broad Range SDS-PAGE Standard (Bio-Rad #1610317)
Lane 7: 01F07-M34Y TriTAC non-reduced
Lane 8: 01F07-M34G-TriTAC non-reduced
Lane 9: 02B05 TriTAC non-reduced
Lane 10: 02G02-M34Y TriTAC non-reduced
Lane 11: 02G02 M34G TriTAC non-reduced
Lane 12: Broad Range SDS-PAGE Standard (Bio-Rad #1610317)

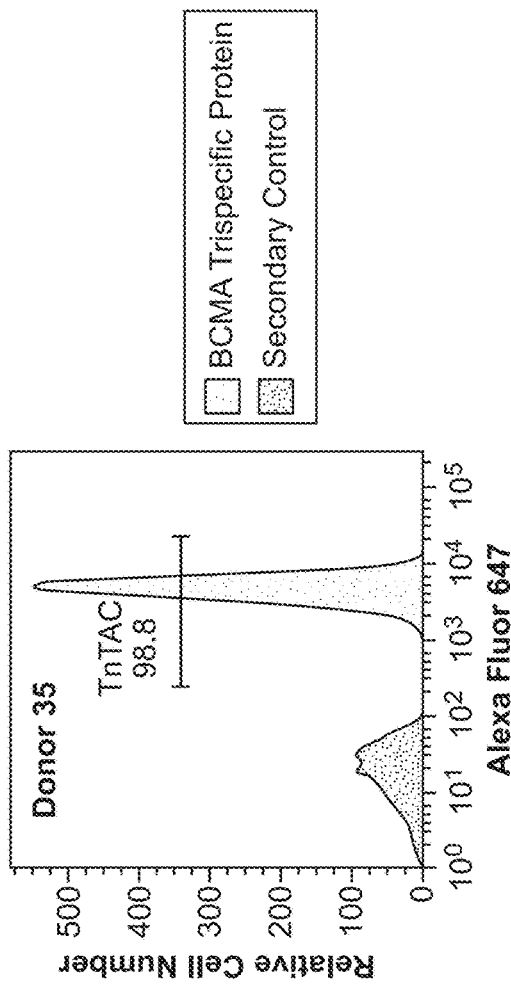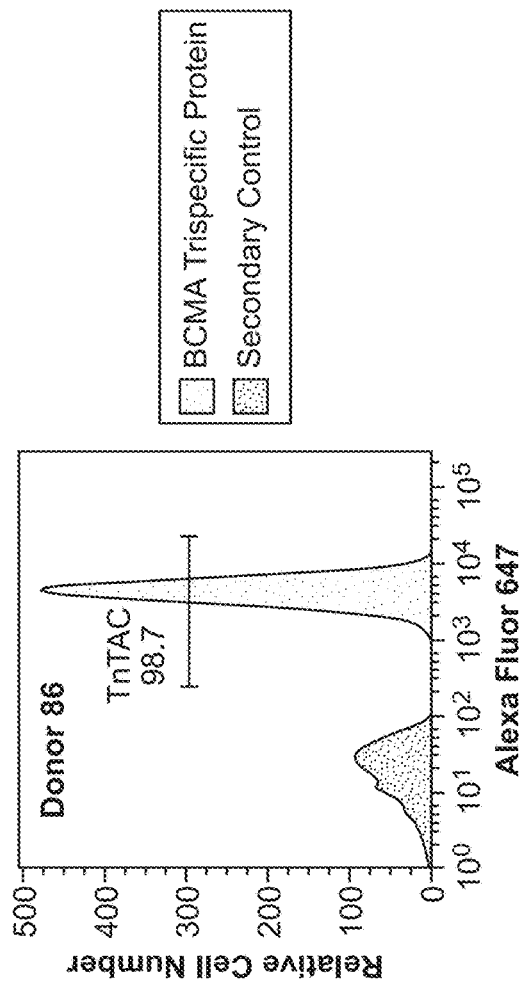
FIG. 5A  FIG. 5B
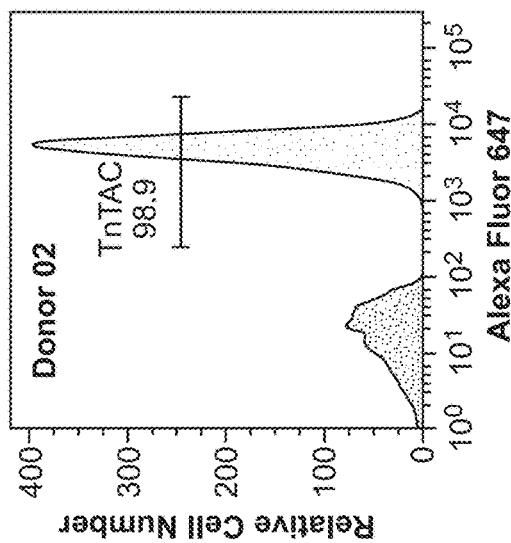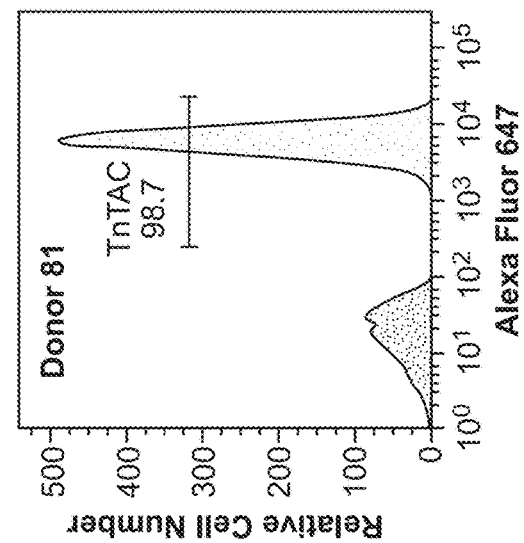
FIG. 5C  FIG. 5D

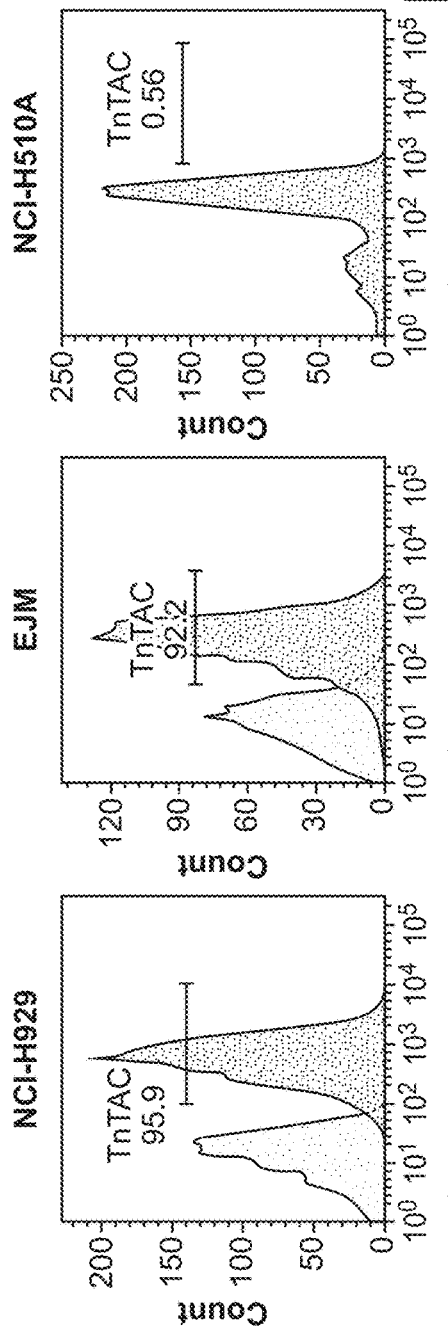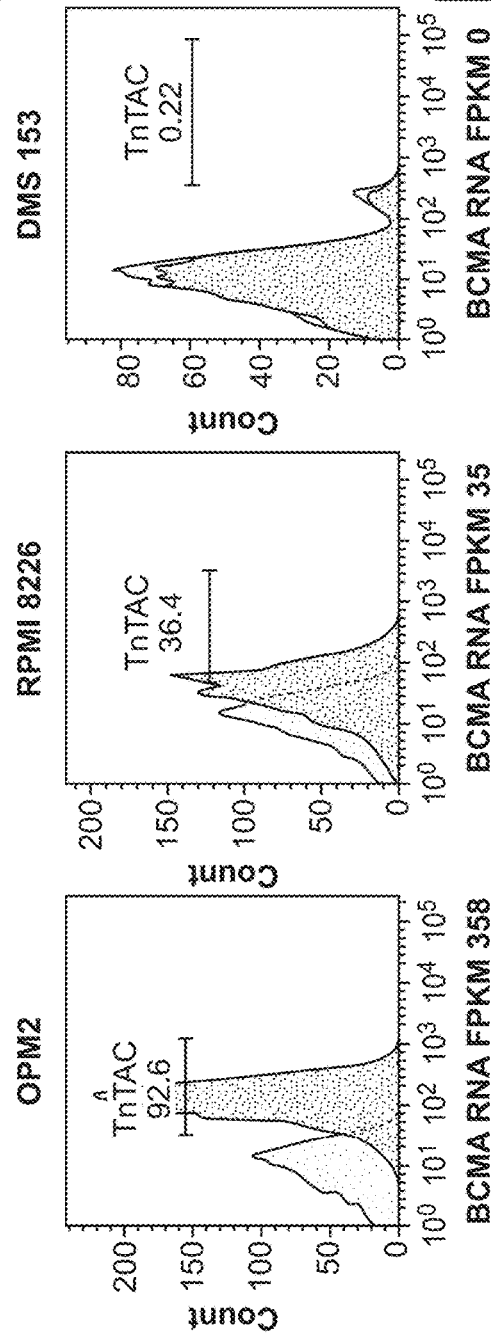
FIG. 6A  FIG. 6B  FIG. 6C
FIG. 6D  FIG. 6E  FIG. 6F

US 11,136,403 B2

TRISPECIFIC PROTEINS AND METHODS OF USE

CROSS-REFERENCE

This application claims the benefit of U.S. Provisional Application No. 62/572,381 filed Oct. 13, 2017, which is incorporated by reference herein in its entirety.

SEQUENCE LISTING

The instant application contains a Sequence Listing which has been submitted electronically in ASCII format and is hereby incorporated by reference in its entirety. Said ASCII copy, created on Oct. 11, 2018, is named 47517-723_201_SL.txt and is 752,020 bytes in size.

BACKGROUND OF THE INVENTION

Cancer is the second leading cause of human death next to coronary disease. Worldwide, millions of people die from cancer every year. In the United States alone, cancer causes the death of well over a half-million people each year, with some 1.4 million new cases diagnosed per year. While deaths from heart disease have been declining significantly, those resulting from cancer generally are on the rise. In the early part of the next century, cancer is predicted to become the leading cause of death.

Moreover, even for those cancer patients that initially survive their primary cancers, common experience has shown that their lives are dramatically altered. Many cancer patients experience strong anxieties driven by the awareness of the potential for recurrence or treatment failure. Many cancer patients experience significant physical debilitations following treatment.

Generally speaking, the fundamental problem in the management of the deadliest cancers is the lack of effective and non-toxic systemic therapies. Cancer is a complex disease characterized by genetic mutations that lead to uncontrolled cell growth. Cancerous cells are present in all organisms and, under normal circumstances, their excessive growth is tightly regulated by various physiological factors.

SUMMARY OF THE INVENTION

The selective destruction of an individual cell or a specific cell type is often desirable in a variety of clinical settings. For example, it is a primary goal of cancer therapy to specifically destroy tumor cells, while leaving healthy cells and tissues intact and undamaged. One such method is by inducing an immune response against the tumor, to make immune effector cells such as natural killer (NK) cells or cytotoxic T lymphocytes (CTLs) attack and destroy tumor cells.

Provided herein is a B cell maturation agent (BCMA) binding trispecific protein that comprises: (a) a first domain (A) which specifically binds to human CD3; (b) a second domain (B) which is a half-life extension domain; and (c) a third domain (C) which specifically binds to BCMA, wherein the domains are linked in the order H2N-(A)-(C)-(B)-COOH, H2N-(B)-(A)-(C)-COOH, H2N-(C)-(B)-(A)-COOH, H2N-(C)-(A)-(B)-COOH, H2N-(A)-(B)-(C)-COOH, or H2N-(B)-(C)-(A)-COOH, wherein the domains are linked by linkers L1 and L2.

In some instances, the first domain comprises a variable light domain and variable heavy domain, each of which is capable of specifically binding to human CD3. The first domain can be humanized or human.

In some instances, the second domain binds albumin. The second domain can comprise a single chain variable fragment (scFv), a variable heavy domain (VH), a variable light domain (VL), a single chain antibody binding domain devoid of light chain (a VHH domain), a peptide, a ligand, or a small molecule.

The third domain is, in some cases, a single chain antibody binding domain devoid of light chain (a VHH domain), a scFv, a VH domain, a VL domain, a non-Ig domain, a ligand, a knottin, or a small molecule entity that specifically binds to BCMA. In some non-limiting instances, the third domain comprises a VHH domain.

In some instances, the first domain, the second domain, and the third domain are independently humanized or human.

Provided herein is a BCMA binding trispecific protein where the VHH domain comprises complementarity determining regions CDR1, CDR2, and CDR3, wherein (a) the amino acid sequence of CDR1 is as set forth in $X_1X_2X_3X_4X_5X_6X_7PX_8G$ (SEQ ID NO: 1), wherein $X_1$ is T or S; $X_2$ is N, D, or S; $X_3$ is I, D, Q, H, V, or E; $X_4$ is F, S, E, A, T, M, V, I, D, Q, P, R, or G; $X_5$ is S, M, R, or N; $X_6$ is I, K, S, T, R, E, D, N, V, H, L, A, Q, or G; $X_7$ is S, T, Y, R, or N; and $X_8$ is M, G, or Y; (b) the amino acid sequence of CDR2 is as set forth in $AIX_9GX_{10}X_{11}TX_{12}YADSVK$ (SEQ ID NO:2), wherein $X_9$ is H, N, or S; $X_{10}$ is F, G, K, R, P, D, Q, H, E, N, T, S, A, I, L, or V; $X_{11}$ is S, Q, E, T, K, or D; and $X_{12}$ is L, V, I, F, Y, or W; and (c) the amino acid sequence of CDR3 is as set forth in $VPWGX_{13}YHPX_{14}X_{15}VX_{16}$ (SEQ ID NO: 3), wherein $X_{13}$ is D, I, T, K, R, A, E, S, or Y; $X_{14}$ is R, G, L, K, T, Q, S, or N; $X_{15}$ is N, K, E, V, R, M, or D; and $X_{16}$ is Y, A, V, K, H, L, M, T, R, Q, C, S, or N.

In one embodiment, the CDR1 does not comprise an amino acid sequence of SEQ ID NO: 599. In one embodiment, the CDR2 does not comprise an amino acid sequence of SEQ ID NO: 600. In one embodiment, the CDR3 does not comprise an amino acid sequence of SEQ ID NO: 601. In one embodiment, the CDR1 and CDR2 do not comprise amino acid sequences of SEQ ID NO: 599 and 600, respectively. In one embodiment, the CDR1 and CDR3 do not comprise amino acid sequences of SEQ ID NO: 599 and 601, respectively. In one embodiment, the CDR2 and CDR3 do not comprise amino acid sequences of SEQ ID NO: 600 and 601, respectively. In one embodiment, the CDR1, CDR2 and CDR3 do not comprise amino acid sequences of SEQ ID NO: 599, 600 and 601, respectively.

Provided herein is a BCMA binding trispecific protein, where the VHH domain comprises the following formula: f1-r1-f2-r2-f3-r3-f4; wherein, r1 is SEQ ID NO: 1; r2 is SEQ ID NO: 2; and r3 is SEQ ID NO: 3; and wherein $f_1$, $f_2$, $f_3$ and $f_4$ are framework residues selected so that said protein is from about eighty percent (80%) to about 99% identical to the amino acid sequence set forth in SEQ ID NO: 598 or 346. Provided herein is a BCMA binding trispecific protein, where the VHH domain comprises the following formula: f1-r1-f2-r2-f3-r3-f4; wherein, r1 is SEQ ID NO: 1; r2 is SEQ ID NO: 2; and r3 is SEQ ID NO: 3; and wherein $f_1$, $f_2$, $f_3$ and $f_4$ are framework residues selected so that said protein is from about 80% to about 90% identical to the amino acid sequence set forth in SEQ ID NO: 598 or 346. In one embodiment, the amino acid sequence of the single domain BCMA binding protein does not comprise SEQ ID NO: 598.

In some non-limiting examples, r1 comprises an amino acid sequence set forth as any one of SEQ ID NOs: 4-117.

In some non-limiting examples, r2 comprises an amino acid sequence set forth as any one of SEQ ID NOs: 118-231.

In some non-limiting examples, r3 comprises an amino acid sequence set forth as any one of SEQ ID NOs: 232-345.

In other non-limiting examples, the protein comprises an amino sequence set forth as any one of SEQ ID NOs: 346-460.

In a single domain BCMA binding protein, f1 comprises, in some instances, SEQ ID NO: 461 or 462.

In a single domain BCMA binding protein, f2 comprises, in some instances, SEQ ID NO: 463.

In a single domain BCMA binding protein, f3 comprises, in some instances, SEQ ID NO: 464 or 465.

In a single domain BCMA binding protein, wherein f4 comprise, in some instances, SEQ ID NO: 466 or 467.

In one non-limiting example, r1 comprises SEQ ID NO: 76, 114, 115, 116 or 117. In one non-limiting example, r1 comprises SEQ ID NO: 76.

In one non-limiting example, r1 comprises SEQ ID NO: 76, r2 is SEQ ID NO: 190, and r3 is SEQ ID NO: 304.

In one non-limiting example, r1 comprises SEQ ID NO: 114, r2 comprises SEQ ID NO: 228 and r3 comprises SEQ ID NO: 342.

In one non-limiting example, r1 comprises SEQ ID NO: 115, r2 comprises SEQ ID NO: 229 and r3 comprises SEQ ID NO: 343.

In one non-limiting example, r1 comprises SEQ ID NO: 117, r2 comprises SEQ ID NO: 231 and r3 comprises SEQ ID NO: 345.

In one non-limiting example, r1 comprises SEQ ID NO: 116, r2 comprises SEQ ID NO: 230 and r3 comprises SEQ ID NO: 344.

The third domain, in some cases, is a human VHH domain, a humanized VHH domain, an affinity matured VHH domain, or a combination thereof.

The BCMA binding trispecific protein, in some instances, has an elimination half-time of at least 12 hours, at least 20 hours, at least 25 hours, at least 30 hours, at least 35 hours, at least 40 hours, at least 45 hours, at least 50 hours, or at least 100 hours.

Provided herein is a BCMA binding trispecific protein that is a VHH domain, where the VHH domain comprises a CDR1, a CDR2, and a CDR3, and wherein the protein comprises the sequence set forth as SEQ ID NO: 346 or 598, wherein amino acid one or more residues selected from amino acid positions 26, 27, 28, 29, 30, 31, 32 and/or 34 of CDR1; positions 52, 54, 55 and/or 57 of CDR2; and positions 101, 105, 106 and/or 108 of CDR3 are substituted, wherein amino acid position 26, if substituted, is substituted with S; amino acid position 27, if substituted, is substituted with D or S; amino acid position 28, if substituted, is substituted with D, Q, H, V, or E; amino acid position 29, if substituted, is substituted with S, E, A, T, M, V, I, D, Q, P, R, or G; amino acid position 30, if substituted, is substituted with M, R, or N; amino acid position 31, if substituted, is substituted with K, S, T, R, E, D, N, V, H, L, A, Q, or G; amino acid position 32, if substituted, is substituted with T, Y, R, or N; amino acid position 34, if substituted, is substituted with G or Y; amino acid position 52, if substituted, is substituted with N or S; amino acid position 54, if substituted, is substituted with G, K, R, P, D, Q, H, E, N, T, S, A, I, L, or V; amino acid position 55, if substituted, is substituted with Q, E, T, K, or D; amino acid position 57, if substituted, is substituted with V, I, F, Y, or W; amino acid position 101, if substituted, is substituted with I, T, K, R, A, E, S, or Y; amino acid position 105, if substituted, is substituted with G, L, K, T, Q, S, or N; amino acid position 106, if substituted, is substituted with K, E, V, R, M, or D; and amino acid position 108, if substituted, is substituted with A, V, K, H, L, M, T, R, Q, C, S, or N. In one non-limiting example, the VHH domain is human, humanized, affinity matured, or a combination thereof.

Provided herein is a BCMA binding trispecific protein, where the third domain binds to a human BCMA protein that comprises a sequence set forth as SEQ ID NO: 468. In some instances, the third domain binds to an epitope of BCMA, wherein said epitope comprises the extracellular domain of BCMA. In some instances, the third domain binds to an epitope of BCMA, wherein said epitope comprises amino acid residues 5-51 of SEQ ID NO: 468.

In such BCMA binding trispecific proteins, linkers L1 and L2 are each independently selected from (GS), (SEQ ID NO: 472), (GGS)$_n$ (SEQ ID NO: 473), (GGGS)$_n$ (SEQ ID NO: 474), (GGSG)$_n$ (SEQ ID NO: 475), (GGSGG)$_n$ (SEQ ID NO: 476), (GGGGS)$_n$ (SEQ ID NO: 477), (GGGGG)$_n$ (SEQ ID NO: 478) or (GGG)$_n$ (SEQ ID NO: 479) wherein n is 1, 2, 3, 4, 5, 6, 7, 8, 9, or 10.

In one non-limiting example, in such BCMA binding trispecific proteins the linkers L1 and L2 are each independently (GGGGS)$_4$ (SEQ ID NO: 480) or (GGGGS)$_3$ (SEQ ID NO: 481).

The domains of a BCMA binding trispecific protein can be linked in the order H$_2$N-(C)-(B)-(A)-COOH.

In some instances, a BCMA binding trispecific protein is less than about 80 kDa. In other instances, a BCMA binding trispecific protein can be about 50 to about 75 kDa. In other instances, a BCMA binding trispecific protein is less than about 60 kDa.

A BCMA binding trispecific protein described herein, in some instances, have an elimination half-time of at least about 50 hours, about 100 hours or more.

A BCMA binding trispecific protein, in some instances, exhibit increased tissue penetration as compared to an IgG to the same BCMA.

A BCMA binding trispecific protein, in some instances, comprises an amino acid sequence selected from the group consisting of SEQ ID NO: 483-597. A BCMA binding trispecific protein, in some instances, comprises an amino acid sequence as set forth in SEQ ID NO: 520.

Provided herein in one embodiment is a B cell maturation agent (BCMA) binding trispecific protein comprising: (a) a first domain (A) which specifically binds to human CD3; (b) a second domain (B) which is a half-life extension domain; and (c) a third domain (C) which specifically binds to BCMA, wherein the third domain comprises an amino sequence set forth as any one of SEQ ID NOS: 346-460.

Provided herein in one embodiment is a B cell maturation agent (BCMA) binding trispecific protein comprising: (a) a first domain (A) which specifically binds to human CD3; (b) a second domain (B) which is a half-life extension domain; and (c) a third domain (C) which specifically binds to BCMA, wherein the third domain comprises complementarity determining regions CDR1, CDR2, and CDR3, wherein CDR1 comprises an amino acid sequence set forth as any one of SEQ ID NOS: 4-117, CDR2 comprises an amino acid sequence set forth as any one of SEQ ID NOS: 118-231, and CDR3 comprises an amino acid sequence set forth as any one of SEQ ID NOS: 232-345.

Provided herein is a pharmaceutical composition comprising a BCMA binding trispecific protein as described herein and a pharmaceutically acceptable carrier.

Also provided herein is a process for the production of a BCMA binding trispecific protein described herein, said process comprising culturing a host transformed or transfected with a vector comprising a nucleic acid sequence encoding a BCMA binding trispecific protein under conditions allowing the expression of the BCMA binding trispecific protein and recovering and purifying the produced protein from the culture.

One embodiment provides a method for the treatment or amelioration of a tumorous disease, an autoimmune disease or an infection disease associated with BCMA in a subject in need thereof, comprising administering to the subject a pharmaceutical composition comprising a BCMA binding trispecific protein, wherein the BCMA binding protein comprises
(a) a first domain (A) which specifically binds to human CD3;
(b) a second domain (B) which is a half-life extension domain; and
(c) a third domain (C) which specifically binds to BCMA, wherein the domains are linked in the order H2N-(A)-(C)-(B)-COOH, H2N-(B)-(A)-(C)-COOH, H2N-(C)-(B)-(A)-COOH, H2N-(C)-(A)-(B)-COOH, H2N-(A)-(B)-(C)-COOH, H2N-(B)-(C)-(A)-COOH, wherein the domains are linked by linkers L1 and L2.

Provided herein is a method for the treatment or amelioration of a tumorous disease, an autoimmune disease or an infection disease associated with BCMA in a subject in need thereof, comprising administering to the subject a pharmaceutical composition as described herein.

A subject to be treated is, in some instances, a human.

In some instances, the method further comprises administration of one or more additional agents in combination with the BCMA binding trispecific protein.

The methods described herein are useful for treatment or amelioration of a tumorous disease, wherein the BCMA binding trispecific protein selectively binds to tumor cells expressing BCMA.

A tumorous disease to be treated with the described methods comprises a primary cancer or a metastasis thereof. In one instance, the tumorous disease comprises a B cell lineage cancer.

A B cell lineage cancer to be treated with the recited methods includes, but is not limited to, a multiple myeloma, a leukemia, a lymphoma, or a metastasis thereof.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 3 is an image of an SDS-PAGE of representative purified BCMA trispecific molecules. Lane 1: 01F07-M34Y TriTAC™ non-reduced; Lane 2: 01F07-M34G-TriTAC™ non-reduced; Lane 3: 02B05 TriTAC™ non-reduced; Lane 4: 02G02-M34Y TriTAC™ non-reduced; Lane 5: 02G02 M34G TriTAC™ non-reduced; Lane 6: Broad Range SDS-PAGE Standard (Bio-Rad #1610317); Lane 7: 01F07-M34Y TriTAC™ non-reduced; Lane 8: 01F07-M34G-TriTAC™ non-reduced; Lane 9: 02B05 TriTAC™ non-reduced; Lane 10: 02G02-M34Y TriTAC™ non-reduced; Lane 11: 02G02 M34G TriTAC™ non-reduced; Lane 12: Broad Range SDS-PAGE Standard (Bio-Rad #1610317)

FIGS. 5A-5D illustrate binding of an exemplary BCMA trispecific targeting protein (02B05) to purified T Cells from four different human donors, donor 02 (FIG. 5A), donor 35 (FIG. 5B), donor 81 (FIG. 5C), donor 86 (FIG. 5D).

FIGS. 6A-6F illustrate binding of an exemplary BCMA trispecific targeting protein (02B05) to cells expressing BCMA, NCI-H929 (FIG. 6A), EJM (FIG. 6B), OPM2 (FIG. 6D), RPMI8226 (FIG. 6E); or cell lines lacking expression of BCMA, NCI-H510A (FIG. 6C) and DMS-153 (FIG. 6F).

DETAILED DESCRIPTION OF THE INVENTION

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

Figure 1:
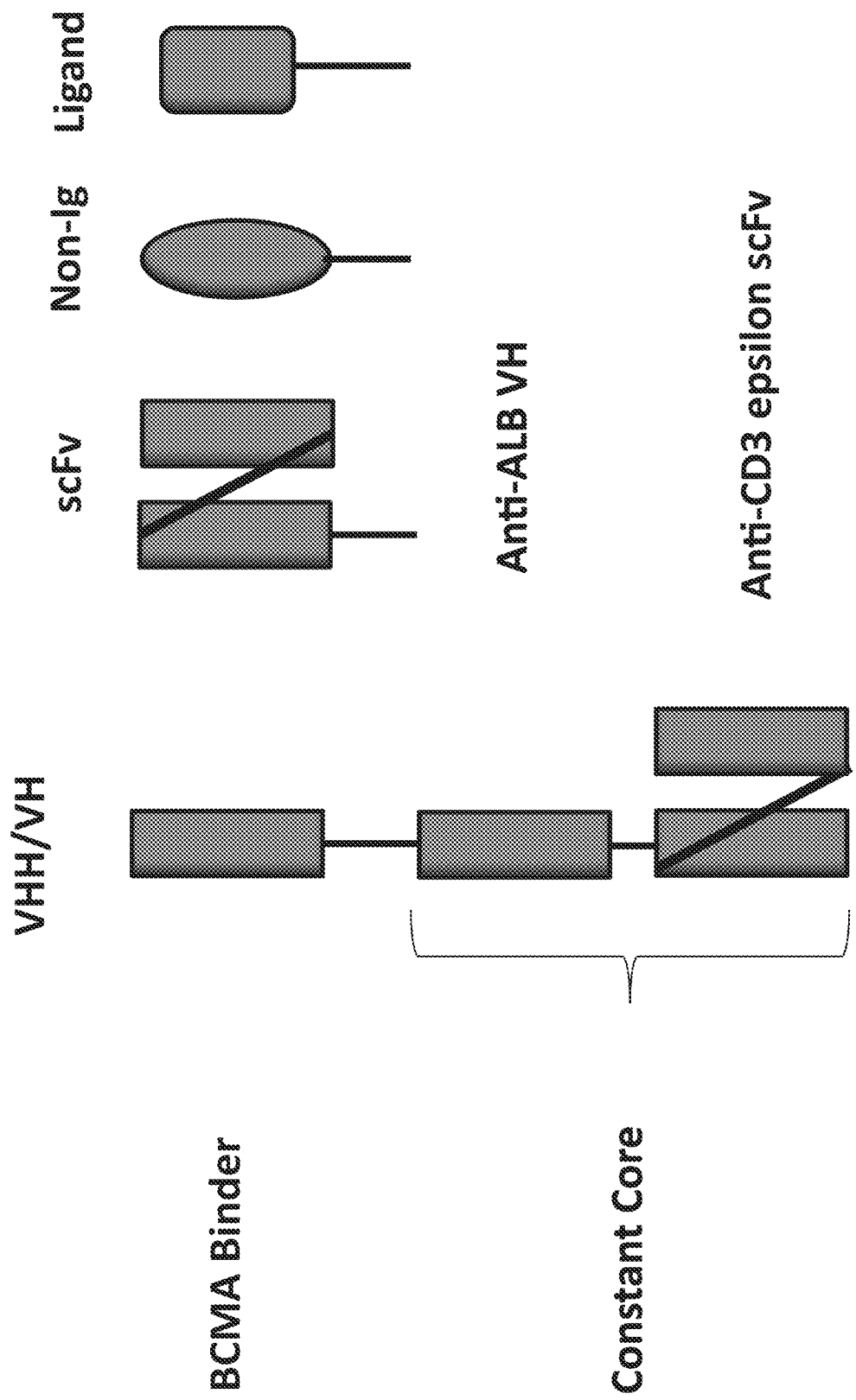
FIG. 1 is schematic representation of an exemplary BCMA targeting trispecific antigen-binding protein where the protein has an constant core element comprising an anti-CD3ε single chain variable fragment (scFv) and an anti-ALB variable heavy chain region; and an anti-BCMA binding domain that can be a VHH, a VH, scFv, a non-Ig binder, or a ligand.

Described herein are trispecific proteins that target B cell maturation antigen (BCMA), pharmaceutical compositions thereof (referred to herein as BCMA binding trispecific protein, BCMA targeting trispecific protein, or BCMA trispecific antigen-binding protein) as well as nucleic acids, recombinant expression vectors and host cells for making such proteins thereof. Also provided are methods of using the disclosed BCMA targeting trispecific proteins in the prevention, and/or treatment of diseases, conditions and disorders. The BCMA targeting trispecific proteins are capable of specifically binding to BCMA as well as CD3 and have a half-life extension domain, such as a domain binding to human albumin (ALB). FIG. 1 depicts a non-limiting example of a trispecific BCMA-binding protein.

An "antibody" typically refers to a Y-shaped tetrameric protein comprising two heavy (H) and two light (L) polypeptide chains held together by covalent disulfide bonds and non-covalent interactions. Human light chains comprise a variable domain (VL) and a constant domain (CL) wherein the constant domain may be readily classified as kappa or lambda based on amino acid sequence and gene loci. Each heavy chain comprises one variable domain (VH) and a constant region, which in the case of IgG, IgA, and IgD, comprises three domains termed CH1, CH2, and CH3 (IgM and IgE have a fourth domain, CH4). In IgG, IgA, and IgD classes the CH1 and CH2 domains are separated by a flexible hinge region, which is a proline and cysteine rich segment of variable length (generally from about 10 to about 60 amino acids in IgG). The variable domains in both the light and heavy chains are joined to the constant domains by a "J" region of about 12 or more amino acids and the heavy chain also has a "D" region of about 10 additional amino acids. Each class of antibody further comprises inter-chain and intra-chain disulfide bonds formed by paired cysteine residues. There are two types of native disulfide bridges or bonds in immunoglobulin molecules: inter-chain and intra-chain disulfide bonds. The location and number of inter-chain disulfide bonds vary according to the immunoglobulin class and species. Inter-chain disulfide bonds are located on the surface of the immunoglobulin, are accessible to solvent and are usually relatively easily reduced. In the human IgG1 isotype there are four inter-chain disulfide bonds, one from each heavy chain to the light chain and two between the heavy chains. The inter-chain disulfide bonds are not required for chain association. As is well known the cysteine rich IgG1 hinge region of the heavy chain has generally been held to consist of three parts: an upper hinge, a core hinge, and a lower hinge. Those skilled in the art will appreciate that the IgG1 hinge region contains the cysteines in the heavy chain that comprise the inter-chain disulfide bonds (two heavy/heavy, two heavy/light), which provide structural flexibility that facilitates Fab movements. The inter-chain disulfide bond between the light and heavy chain of IgG1 are formed between C214 of the kappa or lambda light chain and C220 in the upper hinge region of the heavy chain. The inter-chain disulfide bonds between the heavy chains are at positions C226 and C229 (all numbered per the EU index according to Kabat, et al., infra.).

As used herein the term "antibody" includes polyclonal antibodies, multiclonal antibodies, monoclonal antibodies, chimeric antibodies, humanized and primatized antibodies, CDR grafted antibodies, human antibodies, recombinantly produced antibodies, intrabodies, multispecific antibodies, bispecific antibodies, monovalent antibodies, multivalent antibodies, anti-idiotypic antibodies, synthetic antibodies, including muteins and variants thereof, immunospecific antibody fragments such as Fd, Fab, F(ab')2, F(ab') fragments, single-chain fragments (e.g., ScFv and ScFvFc), disulfide-linked Fvs (sdFv), a Fd fragment consisting of the VH and CH1 domains, linear antibodies, single domain antibodies such as sdAb (VH, VL, or VHH domains); and derivatives thereof including Fc fusions and other modifications, and any other immunoreactive molecule so long as it comprises a domain having a binding site for preferential association or binding with a BCMA protein. Moreover, unless dictated otherwise by contextual constraints the term further comprises all classes of antibodies (i.e. IgA, IgD, IgE, IgG, and IgM) and all subclasses (i.e., IgG1, IgG2, IgG3, IgG4, IgA1, and IgA2). Heavy-chain constant domains that correspond to the different classes of antibodies are typically denoted by the corresponding lower case Greek letter alpha, delta epsilon, gamma, and mu, respectively. Light chains of the antibodies from any vertebrate species can be assigned to one of two clearly distinct types, called kappa (kappa) and lambda (lambda), based on the amino acid sequences of their constant domains.

In some embodiments, the BCMA binding domain of the BCMA targeting trispecific proteins of this disclosure comprise a heavy chain only antibody, such as a VH or a VHH domain. In some cases, the BCMA binding proteins comprise a heavy chain only antibody that is an engineered human VH domain. In some examples, the engineered human VH domain is produced by panning of phage display libraries. In some embodiments, the BCMA binding domain of the BCMA targeting trispecific proteins of this disclosure comprise a VHH. The term "VHH," as used herein, refers to single chain antibody binding domain devoid of light chain. In some cases, a VHH is derived from an antibody of the type that can be found in Camelidae or cartilaginous fish which are naturally devoid of light chains or to a synthetic and non-immunized VHH which can be constructed accordingly. Each heavy chain comprises a variable region encoded by V-, D- and J exons. A VHH, in some cases, is a natural VHH, such as a Camelid-derived VHH, or a recombinant protein comprising a heavy chain variable domain. In some embodiments, the VHH is derived from a species selected from the group consisting of camels, llamas, vicugnas, guanacos, and cartilaginous fish (such as, but not limited to, sharks). In another embodiment, the VHH is derived from an alpaca (such as, but not limited to, a Huacaya Alpaca or a Suri alpaca).

As used herein, "Variable region" or "variable domain" refers to the fact that certain portions of the variable domains differ extensively in sequence among antibodies and are used in the binding and specificity of each particular antibody for its particular antigen. However, the variability is not evenly distributed throughout the variable domains of antibodies. It is concentrated in three segments called complementarity-determining regions (CDRs) or hypervariable regions both in the light-chain (VL) and the heavy-chain (VH) variable domains. The more highly conserved portions of variable domains are called the framework (FR). The variable domains of native heavy and light chains each comprise four FR regions, largely adopting a β-sheet configuration, connected by three CDRs, which form loops connecting, and in some cases forming part of, the β sheet structure. The CDRs in each chain are held together in close proximity by the FR regions and, with the CDRs from the other chain, contribute to the formation of the antigen-binding site of antibodies (see Kabat et al., Sequences of Proteins of Immunological Interest, Fifth Edition, National Institute of Health, Bethesda, Md. (1991)). The constant domains are not involved directly in binding an antibody to an antigen, but exhibit various effector functions, such as participation of the antibody in antibody-dependent cellular toxicity. ScFv fragments (or single chain fragment variable), which in some cases are obtained by genetic engineering, associate in a single polypeptide chain, the VH and the VL region of an antibody, separated by a peptide linker.

In some embodiments of this disclosure, the BCMA binding domain of the BCMA targeting trispecific proteins comprise heavy chain only antibodies, such as VH or VHH domains, and comprise three CDRs. Such heavy chain only antibodies, in some embodiments, bind BCMA as a monomer with no dependency on dimerization with a VL (light chain variable) region for optimal binding affinity. In some embodiments of this disclosure, the CD3 binding domain of the BCMA targeting trispecific proteins comprises a scFv. In some embodiments of this disclosure, the albumin binding domain of the BCMA targeting trispecific proteins comprise a heavy chain only antibody, such as a single domain antibody comprising a VH domain or a VHH domain.

The assignment of amino acids to each domain, framework region and CDR is, in some embodiments, in accordance with one of the numbering schemes provided by Kabat et al. (1991) Sequences of Proteins of Immunological Interest (5th Ed.), US Dept. of Health and Human Services, PHS, NIH, NIH Publication no. 91-3242; Chothia et al., 1987, PMID: 3681981; Chothia et al., 1989, PMID: 2687698; MacCallum et al., 1996, PMID: 8876650; or Dubel, Ed. (2007) Handbook of Therapeutic Antibodies, 3rd Ed., Wily-VCH Verlag GmbH and Co or AbM (Oxford Molecular/MSI Pharmacopia) unless otherwise noted. It is not intended that CDRs of the present disclosure necessarily correspond to the Kabat numbering convention.

The term "Framework" or "FR" residues (or regions) refer to variable domain residues other than the CDR or hypervariable region residues as herein defined. A "human consensus framework" is a framework which represents the most commonly occurring amino acid residue in a selection of human immunoglobulin VL or VH framework sequences.

As used herein, the term "Percent (%) amino acid sequence identity" with respect to a sequence is defined as the percentage of amino acid residues in a candidate sequence that are identical with the amino acid residues in the specific sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as EMBOSS MATCHER, EMBOSS WATER, EMBOSS STRETCHER, EMBOSS NEEDLE, EMBOSS LALIGN, BLAST, BLAST-2, ALIGN or Megalign (DNASTAR) software. Those skilled in the art can determine appropriate parameters for measuring alignment, including any algorithms needed to achieve maximal alignment over the full length of the sequences being compared.

As used herein, "elimination half-time" is used in its ordinary sense, as is described in Goodman and Gillman's The Pharmaceutical Basis of Therapeutics 21-25 (Alfred Goodman Gilman, Louis S. Goodman, and Alfred Gilman, eds., 6th ed. 1980). Briefly, the term is meant to encompass a quantitative measure of the time course of drug elimination. The elimination of most drugs is exponential (i.e., follows first-order kinetics), since drug concentrations usually do not approach those required for saturation of the elimination process. The rate of an exponential process may be expressed by its rate constant, k, which expresses the fractional change per unit of time, or by its half-time, t½ the time required for 50% completion of the process. The units of these two constants are time−1 and time, respectively. A first-order rate constant and the half-time of the reaction are simply related (k×t½=0.693) and may be interchanged accordingly. Since first-order elimination kinetics dictates that a constant fraction of drug is lost per unit time, a plot of the log of drug concentration versus time is linear at all times following the initial distribution phase (i.e. after drug absorption and distribution are complete). The half-time for drug elimination can be accurately determined from such a graph.

As used herein, the term "binding affinity" refers to the affinity of the proteins described in the disclosure to their binding targets, and is expressed numerically using "Kd" values. If two or more proteins are indicated to have comparable binding affinities towards their binding targets, then the Kd values for binding of the respective proteins towards their binding targets, are within 2-fold of each other. If two or more proteins are indicated to have comparable binding affinities towards single binding target, then the Kd values for binding of the respective proteins towards said single binding target, are within ±2-fold of each other. If a protein is indicated to bind two or more targets with comparable binding affinities, then the Kd values for binding of said protein to the two or more targets are within ±2-fold of each other. In general, a higher Kd value corresponds to a weaker binding. In some embodiments, the "Kd" is measured by a radiolabeled antigen binding assay (RIA) or surface plasmon resonance assays using a BIAcore™-2000 or a BIAcore™-3000 (BIAcore, Inc., Piscataway, N.J.). In certain embodiments, an "on-rate" or "rate of association" or "association rate" or "kon" and an "off-rate" or "rate of dissociation" or "dissociation rate" or "koff" are also determined with the surface plasmon resonance technique using a BIAcore™-2000 or a BIAcore™-3000 (BIAcore, Inc., Piscataway, N.J.). In additional embodiments, the "Kd", "kon", and "koff" are measured using the OCTET® Systems (Pall Life Sciences). In an exemplary method for measuring binding affinity using the OCTET® Systems, the ligand, e.g., biotinylated human or cynomolgus BCMA, is immobilized on the OCTET® streptavidin capillary sensor tip surface which streptavidin tips are then activated according to manufacturer's instructions using about 20-50 μg/ml human or cynomolgus BCMA protein. A solution of PBS/Casein is also introduced as a blocking agent. For association kinetic measurements, BCMA binding protein variants are introduced at a concentration ranging from about 10 ng/mL to about 100 μg/mL, about 50 ng/mL to about 5 μg/mL, or about 2 ng/mL to about 20 μg/mL. In some embodiments, the BCMA binding single domain proteins are used at a concentration ranging from about 2 ng/mL to about 20 μg/mL. Complete dissociation is observed in case of the negative control, assay buffer without the binding proteins. The kinetic parameters of the binding reactions are then determined using an appropriate tool, e.g., ForteBio software.

The term "about" or "approximately" means within an acceptable error range for the particular value as determined by one of ordinary skill in the art, which will depend in part on how the value is measured or determined, e.g., the limitations of the measurement system. For example, "about" can mean within 1 or more than 1 standard deviation, per the practice in the given value. Where particular values are described in the application and claims, unless otherwise stated the term "about" should be assumed to mean an acceptable error range for the particular value.

The terms "individual," "patient," or "subject" are used interchangeably. None of the terms require or are limited to situations characterized by the supervision (e.g. constant or intermittent) of a health care worker (e.g. a doctor, a registered nurse, a nurse practitioner, a physician's assistant, an orderly, or a hospice worker).

The terminology used herein is for the purpose of describing particular cases only and is not intended to be limiting. As used herein, the singular forms "a," "an" and "the" are intended to include the plural forms as well, unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising."

In one aspect, the BCMA targeting trispecific proteins comprise a domain (A) which specifically binds to CD3, a domain (B) which specifically binds to human albumin (ALB), and a domain (C) which specifically binds to BCMA. The three domains in BCMA targeting trispecific proteins are arranged in any order. Thus, it is contemplated that the domain order of the BCMA targeting trispecific proteins are:

H$_2$N-(A)-(B)-(C)-COOH,
H$_2$N-(A)-(C)-(B)-COOH,
H$_2$N-(B)-(A)-(C)-COOH,
H$_2$N-(B)-(C)-(A)-COOH,
H$_2$N-(C)-(B)-(A)-COOH, or
H$_2$N-(C)-(A)-(B)-COOH.

In some embodiments, the BCMA targeting trispecific proteins have a domain order of H₂N-(A)-(B)-(C)-COOH. In some embodiments, the BCMA targeting trispecific proteins have a domain order of H₂N-(A)-(C)-(B)-COOH. In some embodiments, the BCMA targeting trispecific proteins have a domain order of H₂N-(B)-(A)-(C)-COOH. In some embodiments, the BCMA targeting trispecific proteins have a domain order of H₂N-(B)-(C)-(A)-COOH. In some embodiments, the BCMA targeting trispecific proteins have a domain order of H₂N-(C)-(B)-(A)-COOH. In some embodiments, the BCMA targeting trispecific proteins have a domain order of H₂N-(C)-(A)-(B)-COOH. In some embodiments, the anti-BCMA domain (the anti-target domain, T), the anti-CD3 domain (C), and the anti-ALB domain (A) are in an anti-CD3: anti-ALB: anti-BCMA (CAT) orientation. In some embodiments, the anti-BCMA domain (the anti-target domain, T) the anti-CD3 domain (C), and the anti-ALB domain (A) are in an anti-BCMA: anti-ALB: anti-CD3 (TAC) orientation.

In some embodiments, the BCMA targeting trispecific proteins have the HSA binding domain as the middle domain, such that the domain order is H₂N-(A)-(B)-(C)-COOH or H2N-(C)-(B)-(A)-COOH. It is contemplated that in such embodiments where the ALB binding domain as the middle domain, the CD3 and BCMA binding domains are afforded additional flexibility to bind to their respective targets.

In some embodiments, the BCMA targeting trispecific proteins described herein comprise a polypeptide having a sequence described in the Sequence Table (SEQ ID NO: 483-597) and subsequences thereof. In some embodiments, the trispecific antigen binding protein comprises a polypeptide having at least 70%-95% or more homology to a sequence described in the Sequence Table (SEQ ID NO: 483-597). In some embodiments, the trispecific antigen binding protein comprises a polypeptide having at least 70%, 75%, 80%, 85%, 90%, 95%, or more homology to a sequence described in the Sequence Table 1 (SEQ ID NO: 483-597).

The BCMA targeting trispecific proteins described herein are designed to allow specific targeting of cells expressing BCMA by recruiting cytotoxic T cells. This improves efficacy compared to ADCC (antibody dependent cell-mediated cytotoxicity), which is using full length antibodies directed to a sole antigen and is not capable of directly recruiting cytotoxic T cells. In contrast, by engaging CD3 molecules expressed specifically on these cells, the BCMA targeting trispecific proteins can crosslink cytotoxic T cells with cells expressing BCMA in a highly specific fashion, thereby directing the cytotoxic potential of the T cell towards the target cell. The BCMA targeting trispecific proteins described herein engage cytotoxic T cells via binding to the surface-expressed CD3 proteins, which form part of the TCR. Simultaneous binding of several BCMA trispecific antigen-binding protein to CD3 and to BCMA expressed on the surface of particular cells causes T cell activation and mediates the subsequent lysis of the particular BCMA expressing cell. Thus, BCMA targeting trispecific proteins are contemplated to display strong, specific and efficient target cell killing. In some embodiments, the BCMA targeting trispecific proteins described herein stimulate target cell killing by cytotoxic T cells to eliminate pathogenic cells (e.g., tumor cells expressing BCMA). In some of such embodiments, cells are eliminated selectively, thereby reducing the potential for toxic side effects.

The BCMA targeting trispecific proteins described herein confer further therapeutic advantages over traditional monoclonal antibodies and other smaller bispecific molecules. Generally, the effectiveness of recombinant protein pharmaceuticals depends heavily on the intrinsic pharmacokinetics of the protein itself. One such benefit here is that the BCMA targeting trispecific proteins described herein have extended pharmacokinetic elimination half-time due to having a half-life extension domain such as a domain specific to HSA. In this respect, the BCMA targeting trispecific proteins described herein have an extended serum elimination half-time of about two, three, about five, about seven, about 10, about 12, or about 14 days in some embodiments. This contrasts to other binding proteins such as BiTE or DART molecules which have relatively much shorter elimination half-times. For example, the BiTE CD19×CD3 bispecific scFv-scFv fusion molecule requires continuous intravenous infusion (i.v.) drug delivery due to its short elimination half-time. The longer intrinsic half-times of the BCMA targeting trispecific proteins solve this issue thereby allowing for increased therapeutic potential such as low-dose pharmaceutical formulations, decreased periodic administration and/or novel pharmaceutical compositions.

The BCMA targeting trispecific proteins described herein also have an optimal size for enhanced tissue penetration and tissue distribution. Larger sizes limit or prevent penetration or distribution of the protein in the target tissues. The BCMA targeting trispecific proteins described herein avoid this by having a small size that allows enhanced tissue penetration and distribution. Accordingly, the BCMA targeting trispecific proteins described herein, in some embodiments have a size of about 50 kD to about 80 kD, about 50 kD to about 75 kD, about 50 kD to about 70 kD, or about 50 kD to about 65 kD. Thus, the size of the BCMA targeting trispecific proteins is advantageous over IgG antibodies which are about 150 kD and the BiTE and DART diabody molecules which are about 55 kD but are not half-life extended and therefore cleared quickly through the kidney.

In further embodiments, the BCMA targeting trispecific proteins described herein have an optimal size for enhanced tissue penetration and distribution. In these embodiments, the BCMA targeting trispecific proteins are constructed to be as small as possible, while retaining specificity toward its targets. Accordingly, in these embodiments, the BCMA targeting trispecific proteins described herein have a size of about 20 kD to about 40 kD or about 25 kD to about 35 kD to about 40 kD, to about 45 kD, to about 50 kD, to about 55 kD, to about 60 kD, to about 65 kD. In some embodiments, the BCMA targeting trispecific proteins described herein have a size of about 50 kD, 49, kD, 48 kD, 47 kD, 46 kD, 45 kD, 44 kD, 43 kD, 42 kD, 41 kD, 40 kD, about 39 kD, about 38 kD, about 37 kD, about 36 kD, about 35 kD, about 34 kD, about 33 kD, about 32 kD, about 31 kD, about 30 kD, about 29 kD, about 28 kD, about 27 kD, about 26 kD, about 25 kD, about 24 kD, about 23 kD, about 22 kD, about 21 kD, or about 20 kD. An exemplary approach to the small size is through the use of single domain antibody (sdAb) fragments for each of the domains. For example, a particular BCMA trispecific antigen-binding protein has an anti-CD3 sdAb, anti-ALB sdAb and an sdAb for BCMA. This reduces the size of the exemplary BCMA trispecific antigen-binding protein to under 40 kD. Thus in some embodiments, the domains of the BCMA targeting trispecific proteins are all single domain antibody (sdAb) fragments. In other embodiments, the BCMA targeting trispecific proteins described herein comprise small molecule entity (SME) binders for ALB and/or the BCMA. SME binders are small molecules averaging about 500 to 2000 Da in size and are attached to the BCMA targeting trispecific proteins by known methods, such as sortase ligation or conjugation. In these instances, one of the domains of BCMA trispecific antigen-binding protein is a sortase recognition sequence, e.g., LPETG (SEQ ID NO: 482). To attach a SME binder to BCMA trispecific antigen-binding protein with a sortase recognition sequence, the protein is incubated with a sortase and a SME binder whereby the sortase attaches the SME binder to the recognition sequence. Known SME binders include MIP-1072 and MIP-1095 which bind to BCMA.

In yet other embodiments, the domain which binds to BCMA of BCMA targeting trispecific proteins described herein comprise a knottin peptide for binding BCMA. Knottins are disulfide-stabilized peptides with a cysteine knot scaffold and have average sizes about 3.5 kD. Knottins have been contemplated for binding to certain tumor molecules such as BCMA. In further embodiments, domain which binds to BCMA of BCMA targeting trispecific proteins described herein comprise a natural BCMA ligand.

Another feature of the BCMA targeting trispecific proteins described herein is that they are of a single-polypeptide design with flexible linkage of their domains. This allows for facile production and manufacturing of the BCMA targeting trispecific proteins as they can be encoded by single cDNA molecule to be easily incorporated into a vector. Further, because the BCMA targeting trispecific proteins described herein are a monomeric single polypeptide chain, there are no chain pairing issues or a requirement for dimerization. It is contemplated that the BCMA targeting trispecific proteins described herein have a reduced tendency to aggregate unlike other reported molecules such as bispecific proteins with Fc-gamma immunoglobulin domains.

In the BCMA targeting trispecific proteins described herein, the domains are linked by internal linkers L1 and L2, where L1 links the first and second domain of the BCMA targeting trispecific proteins and L2 links the second and third domains of the BCMA targeting trispecific proteins. Linkers L1 and L2 have an optimized length and/or amino acid composition. In some embodiments, linkers L1 and L2 are the same length and amino acid composition. In other embodiments, L1 and L2 are different. In certain embodiments, internal linkers L1 and/or L2 are "short", i.e., consist of 0, 1, 2, 3, 4, 5, 6, 7, 8, 9, 10, 11 or 12 amino acid residues. Thus, in certain instances, the internal linkers consist of about 12 or less amino acid residues. In the case of 0 amino acid residues, the internal linker is a peptide bond. In certain embodiments, internal linkers L1 and/or L2 are "long", i.e., "consist of" 15, 20 or 25 amino acid residues. In some embodiments, these internal linkers consist of about 3 to about 15, for example 8, 9 or 10 contiguous amino acid residues. Regarding the amino acid composition of the internal linkers L1 and L2, peptides are selected with properties that confer flexibility to the BCMA targeting trispecific proteins, do not interfere with the binding domains as well as resist cleavage from proteases. For example, glycine and serine residues generally provide protease resistance. Examples of internal linkers suitable for linking the domains in the BCMA targeting trispecific proteins include but are not limited to (GS)n (SEQ ID NO: 472), (GGS)n (SEQ ID NO: 473), (GGGS)n (SEQ ID NO: 474), (GGSG)n (SEQ ID NO: 475), (GGSGG)n (SEQ ID NO: 476), (GGGGS)n (SEQ ID NO: 477), (GGGGG)n (SEQ ID NO: 478), or (GGG)n (SEQ ID NO: 479), wherein n is 1, 2, 3, 4, 5, 6, 7, 8, 9, or 10. In one embodiment, internal linker L1 and/or L2 is (GGGGS)4 (SEQ ID NO: 480) or (GGGGS)3 (SEQ ID NO: 481).

CD3 Binding Domain

The specificity of the response of T cells is mediated by the recognition of an antigen (displayed in context of a major histocompatibility complex, MHC) by the TCR. As part of the TCR, CD3 is a protein complex that includes a CD3γ (gamma) chain, a CD3δ (delta) chain, and two CD3ε (epsilon) chains which are present on the cell surface. CD3 associates with the α (alpha) and p (beta) chains of the TCR as well as CD3 ((zeta) altogether to comprise the complete TCR. Clustering of CD3 on T cells, such as by immobilized anti-CD3 antibodies leads to T cell activation similar to the engagement of the T cell receptor but independent of its clone-typical specificity.

In one aspect, the BCMA targeting trispecific proteins described herein comprise a domain which specifically binds to CD3. In one aspect, the BCMA targeting trispecific proteins described herein comprise a domain which specifically binds to human CD3. In some embodiments, the BCMA targeting trispecific proteins described herein comprise a domain which specifically binds to CD3γ. In some embodiments, the BCMA targeting trispecific proteins described herein comprise a domain which specifically binds to CD3δ. In some embodiments, the BCMA targeting trispecific proteins described herein comprise a domain which specifically binds to CD3ε.

In further embodiments, the BCMA targeting trispecific proteins described herein comprise a domain which specifically binds to the TCR. In certain instances, the BCMA targeting trispecific proteins described herein comprise a domain which specifically binds the a chain of the TCR. In certain instances, the BCMA targeting trispecific proteins described herein comprise a domain which specifically binds the β chain of the TCR.

In some embodiments, the CD3 binding domain of the BCMA trispecific antigen-binding protein can be any domain that binds to CD3 including but not limited to domains from a monoclonal antibody, a polyclonal antibody, a recombinant antibody, a human antibody, a humanized antibody. In some instances, it is beneficial for the CD3 binding domain to be derived from the same species in which the BCMA trispecific antigen-binding protein will ultimately be used in. For example, for use in humans, it may be beneficial for the CD3 binding domain of the BCMA trispecific antigen-binding protein to comprise human or humanized residues from the antigen binding domain of an antibody or antibody fragment.

Thus, in one aspect, the antigen-binding domain comprises a humanized or human antibody or an antibody fragment, or a murine antibody or antibody fragment. In one embodiment, the humanized or human anti-CD3 binding domain comprises one or more (e.g., all three) light chain complementary determining region 1 (LC CDR1), light chain complementary determining region 2 (LC CDR2), and light chain complementary determining region 3 (LC CDR3) of a humanized or human anti-CD3 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a humanized or human anti-CD3 binding domain described herein, e.g., a humanized or human anti-CD3 binding domain comprising one or more, e.g., all three, LC CDRs and one or more, e.g., all three, HC CDRs.

In some embodiments, the humanized or human anti-CD3 binding domain comprises a humanized or human light chain variable region specific to CD3 where the light chain variable region specific to CD3 comprises human or non-human light chain CDRs in a human light chain framework region. In certain instances, the light chain framework region is a κ (lamda) light chain framework. In other instances, the light chain framework region is a κ (kappa) light chain framework.

In some embodiments, the humanized or human anti-CD3 binding domain comprises a humanized or human heavy chain variable region specific to CD3 where the heavy chain variable region specific to CD3 comprises human or non-human heavy chain CDRs in a human heavy chain framework region.

In certain instances, the complementary determining regions of the heavy chain and/or the light chain are derived from known anti-CD3 antibodies, such as, for example, muromonab-CD3 (OKT3), otelixizumab (TRX4), teplizumab (MGA031), visilizumab (Nuvion), SP34, TR-66 or X35-3, VIT3, BMA030 (BW264/56), CLB-T3/3, CRIS7, YTH12.5, F111-409, CLB-T3.4.2, TR-66, WT32, SPv-T3b, 11D8, XIII-141, XIII-46, XIII-87, 12F6, T3/RW2-8C8, T3/RW2-4B6, OKT3D, M-T301, SMC2, F101.01, UCHT-1 and WT-31.

In one embodiment, the anti-CD3 binding domain is a single chain variable fragment (scFv) comprising a light chain and a heavy chain of an amino acid sequence provided herein. As used herein, "single chain variable fragment" or "scFv" refers to an antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single polypeptide chain, and wherein the scFv retains the specificity of the intact antibody from which it is derived. In an embodiment, the anti-CD3 binding domain comprises: a light chain variable region comprising an amino acid sequence having at least one, two or three modifications (e.g., substitutions) but not more than 30, 20 or 10 modifications (e.g., substitutions) of an amino acid sequence of a light chain variable region provided herein, or a sequence with 95-99% identity with an amino acid sequence provided herein; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided herein, or a sequence with 95-99% identity to an amino acid sequence provided herein. In one embodiment, the humanized or human anti-CD3 binding domain is a scFv, and a light chain variable region comprising an amino acid sequence described herein, is attached to a heavy chain variable region comprising an amino acid sequence described herein, via a scFv linker. The light chain variable region and heavy chain variable region of a scFv can be, e.g., in any of the following orientations: light chain variable region-scFv linker-heavy chain variable region or heavy chain variable region-scFv linker-light chain variable region.

In some instances, scFvs which bind to CD3 are prepared according to known methods. For example, scFv molecules can be produced by linking VH and VL regions together using flexible polypeptide linkers. The scFv molecules comprise a scFv linker (e.g., a Ser-Gly linker) with an optimized length and/or amino acid composition. Accordingly, in some embodiments, the length of the scFv linker is such that the VH or VL domain can associate intermolecularly with the other variable domain to form the CD3 binding site. In certain embodiments, such scFv linkers are "short", i.e. consist of 0, 1, 2, 3, 4, 5, 6, 7, 8, 9, 10, 11 or 12 amino acid residues. Thus, in certain instances, the scFv linkers consist of about 12 or less amino acid residues. In the case of 0 amino acid residues, the scFv linker is a peptide bond. In some embodiments, these scFv linkers consist of about 3 to about 15, for example 8, 9 or 10 contiguous amino acid residues. Regarding the amino acid composition of the scFv linkers, peptides are selected that confer flexibility, do not interfere with the variable domains as well as allow inter-chain folding to bring the two variable domains together to form a functional CD3 binding site. For example, scFv linkers comprising glycine and serine residues generally provide protease resistance. In some embodiments, linkers in a scFv comprise glycine and serine residues. The amino acid sequence of the scFv linkers can be optimized, for example, by phage-display methods to improve the CD3 binding and production yield of the scFv. Examples of peptide scFv linkers suitable for linking a variable light domain and a variable heavy domain in a scFv include but are not limited to $(GS)_n$ (SEQ ID NO: 472), $(GGS)_n$ (SEQ ID NO: 473), $(GGGS)_n$ (SEQ ID NO: 474), $(GGSG)_n$ (SEQ ID NO: 475), $(GGSGG)_n$ (SEQ ID NO: 476), $(GGGGS)_n$ (SEQ ID NO: 477), $(GGGGG)_n$ (SEQ ID NO: 478), or $(GGG)_n$ (SEQ ID NO: 479), wherein n is 1, 2, 3, 4, 5, 6, 7, 8, 9, or 10. In one embodiment, internal linker L1 and/or L2 is $(GGGGS)_4$ (SEQ ID NO: 480) or $(GGGGS)_3$ (SEQ ID NO: 481). Variation in the linker length may retain or enhance activity, giving rise to superior efficacy in activity studies.

In some embodiments, CD3 binding domain of BCMA trispecific antigen-binding protein has an affinity to CD3 on CD3 expressing cells with a $K_D$ of 1000 nM or less, 500 nM or less, 200 nM or less, 100 nM or less, 80 nM or less, 50 nM or less, 20 nM or less, 10 nM or less, 5 nM or less, 1 nM or less, or 0.5 nM or less. In some embodiments, the CD3 binding domain of BCMA trispecific antigen-binding protein has an affinity to CD3ε, γ, or δ with a $K_D$ of 1000 nM or less, 500 nM or less, 200 nM or less, 100 nM or less, 80 nM or less, 50 nM or less, 20 nM or less, 10 nM or less, 5 nM or less, 1 nM or less, or 0.5 nM or less. In further embodiments, CD3 binding domain of BCMA trispecific antigen-binding protein has low affinity to CD3, i.e., about 100 nM or greater.

The affinity to bind to CD3 can be determined, for example, by the ability of the BCMA trispecific antigen-binding protein itself or its CD3 binding domain to bind to CD3 coated on an assay plate; displayed on a microbial cell surface; in solution; etc. The binding activity of the BCMA trispecific antigen-binding protein itself or its CD3 binding domain of the present disclosure to CD3 can be assayed by immobilizing the ligand (e.g., CD3) or the BCMA trispecific antigen-binding protein itself or its CD3 binding domain, to a bead, substrate, cell, etc. Agents can be added in an appropriate buffer and the binding partners incubated for a period of time at a given temperature. After washes to remove unbound material, the bound protein can be released with, for example, SDS, buffers with a high pH, and the like and analyzed, for example, by Surface Plasmon Resonance (SPR).

Half-Life Extension Domain

Contemplated herein are domains which extend the half-life of an antigen-binding domain. Such domains are contemplated to include but are not limited to Albumin binding domains, Fc domains, small molecules, and other half-life extension domains known in the art.

Human albumin (ALB) (molecular mass of about 67 kDa) is the most abundant protein in plasma, present at about 50 mg/ml (600 μM), and has a half-life of around 20 days in humans. ALB serves to maintain plasma pH, contributes to colloidal blood pressure, functions as carrier of many metabolites and fatty acids, and serves as a major drug transport protein in plasma.

Noncovalent association with albumin extends the elimination half-time of short lived proteins. For example, a recombinant fusion of an albumin binding domain to a Fab fragment resulted in an in vivo clearance of 25- and 58-fold and a half-life extension of 26- and 37-fold when administered intravenously to mice and rabbits respectively as compared to the administration of the Fab fragment alone. In another example, when insulin is acylated with fatty acids to promote association with albumin, a protracted effect was observed when injected subcutaneously in rabbits or pigs. Together, these studies demonstrate a linkage between albumin binding and prolonged action.

In one aspect, the BCMA targeting trispecific proteins described herein comprise a half-life extension domain, for example a domain which specifically binds to ALB. In some embodiments, the ALB binding domain of BCMA trispecific antigen-binding protein can be any domain that binds to ALB including but not limited to domains from a monoclonal antibody, a polyclonal antibody, a recombinant antibody, a human antibody, a humanized antibody. In some embodiments, the ALB binding domain is a single chain variable fragments (scFv), single-domain antibody such as a heavy chain variable domain (VH), a light chain variable domain (VL) and a variable domain (VHH) of camelid derived single domain antibody, peptide, ligand or small molecule entity specific for HSA. In certain embodiments, the ALB binding domain is a single-domain antibody. In other embodiments, the HSA binding domain is a peptide. In further embodiments, the HSA binding domain is a small molecule. It is contemplated that the HSA binding domain of BCMA trispecific antigen-binding protein is fairly small and no more than 25 kD, no more than 20 kD, no more than 15 kD, or no more than 10 kD in some embodiments. In certain instances, the ALB binding is 5 kD or less if it is a peptide or small molecule entity.

The half-life extension domain of BCMA trispecific antigen-binding protein provides for altered pharmacodynamics and pharmacokinetics of the BCMA trispecific antigen-binding protein itself. As above, the half-life extension domain extends the elimination half-time. The half-life extension domain also alters pharmacodynamic properties including alteration of tissue distribution, penetration, and diffusion of the trispecific antigen-binding protein. In some embodiments, the half-life extension domain provides for improved tissue (including tumor) targeting, tissue distribution, tissue penetration, diffusion within the tissue, and enhanced efficacy as compared with a protein without a half-life extension domain. In one embodiment, therapeutic methods effectively and efficiently utilize a reduced amount of the trispecific antigen-binding protein, resulting in reduced side effects, such as reduced non-tumor cell cytotoxicity.

Further, the binding affinity of the half-life extension domain can be selected so as to target a specific elimination half-time in a particular trispecific antigen-binding protein. Thus, in some embodiments, the half-life extension domain has a high binding affinity. In other embodiments, the half-life extension domain has a medium binding affinity. In yet other embodiments, the half-life extension domain has a low or marginal binding affinity. Exemplary binding affinities include KD concentrations at 10 nM or less (high), between 10 nM and 100 nM (medium), and greater than 100 nM (low). As above, binding affinities to ALB are determined by known methods such as Surface Plasmon Resonance (SPR).

In some embodiments, ALB binding domains described herein comprise a single domain antibody.

B Cell Maturation Antigen (BCMA) Binding Domain

B cell maturation antigen (BCMA, TNFRSF17, CD269) is a transmembrane protein belonging to the tumor necrosis family receptor (TNFR) super family that is primarily expressed on terminally differentiated B cells. BCMA expression is restricted to the B cell lineage and mainly present on plasma cells and plasmablasts and to some extent on memory B cells, but virtually absent on peripheral and naive B cells. BCMA is also expressed on multiple myeloma (MM) cells, on leukemia cells and lymphoma cells.

BCMA was identified through molecular analysis of a t(4;16)(q26;p13) translocation found in a human intestinal T cell lymphoma and an in-frame sequence was mapped to the 16p13.1 chromosome band.

Human BCMA cDNA has an open reading frame of 552 bp that encodes a 184 amino acid polypeptide. The BCMA gene is organized into three exons that are separated by two introns, each flanked by GT donor and AG acceptor consensus splicing sites, and codes for a transcript of 1.2 kb. The structure of BCMA protein includes an integral transmembrane protein based on a central 24 amino acid hydrophobic region in an alpha-helix structure.

The murine BCMA gene is located on chromosome 16 syntenic to the human 16p13 region, and also includes three exons that are separated by two introns. The gene encodes a 185 amino acid protein. Murine BCMA mRNA is expressed as a 404 bp transcript at the highest levels in plasmacytoma cells (J558) and at modest levels in the A20 B cell lymphoma line. Murine BCMA mRNA transcripts have also been detected at low levels in T cell lymphoma (EL4, BW5147) and dendritic cell (CB1D6, D2SC1) lines in contrast to human cell lines of T cell and dendritic cell origin. The murine BCMA cDNA sequence has 69.3% nucleotide identity with the human BCMA cDNA sequence and slightly higher identity (73.7%) when comparing the coding regions between these two cDNA sequences. Mouse BCMA protein is 62% identical to human BCMA protein and, like human BCMA, contains a single hydrophobic region, which may be an internal transmembrane segment. The N-terminal 40 amino acid domain of both murine and human BCMA protein have six conserved cysteine residues, consistent with the formation of a cysteine repeat motif found in the extracellular domain of TNFRs. Similar to members of the TNFR superfamily, BCMA protein contains a conserved aromatic residue four to six residues C-terminal from the first cysteine.

BCMA is not expressed at the cell surface, but rather, is located on the Golgi apparatus. The amount of BCMA expression is proportional to the stage of cellular differentiation (highest in plasma cells).

It is involved in B cell development and homeostasis due to its interaction with its ligands BAFF (B cell activating factor, also designated as TALL-1 or TNFSF13B) and APRIL (A proliferation inducing ligand).

BCMA regulates different aspects of humoral immunity, B cell development and homeostasis along with its family members TACI (transmembrane activator and cyclophylin ligand interactor) and BAFF-R (B cell activation factor receptor, also known as tumor necrosis factor receptor superfamily member 13C). Expression of BCMA appears rather late in B cell differentiation and contributes to the long term survival of plasmablasts and plasma cells in the bone marrow. BCMA also supports growth and survival of multiple myeloma (MM) cells.

BCMA is mostly known for its functional activity in mediating the survival of plasma cells that maintain long-term humoral immunity.

There is a need for having treatment options for solid tumor diseases related to the overexpression of BCMA, such as cancer multiple myeloma, leukemias and lymphomas. The present disclosure provides, in certain embodiments, single domain proteins which specifically bind to BCMA on the surface of tumor target cells.

The design of the BCMA targeting trispecific proteins described herein allows the binding domain to BCMA to be flexible in that the binding domain to BCMA can be any type of binding domain, including but not limited to, domains from a monoclonal antibody, a polyclonal antibody, a recombinant antibody, a human antibody, a humanized antibody. In some embodiments, the binding domain to BCMA is a single chain variable fragments (scFv), single-domain antibody such as a heavy chain variable domain (VH), a light chain variable domain (VL) and a variable domain (VHH) of camelid derived single domain antibody. In other embodiments, the binding domain to BCMA is a non-Ig binding domain, i.e., antibody mimetic, such as anticalins, affilins, affibody molecules, affimers, affitins, alphabodies, avimers, DARPins, fynomers, kunitz domain peptides, and monobodies. In further embodiments, the binding domain to BCMA is a ligand or peptide that binds to or associates with BCMA. In yet further embodiments, the binding domain to BCMA is a knottin. In yet further embodiments, the binding domain to BCMA is a small molecular entity.

In some embodiments, the BCMA binding domain binds to a protein comprising the sequence of SEQ ID NO: 469, 470 or 471. In some embodiments, the BCMA binding domain binds to a protein comprising a truncated sequence compared to SEQ ID NO: 469, 470 or 471.

In some embodiments, the BCMA binding domain is an anti-BCMA antibody or an antibody variant. As used herein, the term "antibody variant" refers to variants and derivatives of an antibody described herein. In certain embodiments, amino acid sequence variants of the anti-BCMA antibodies described herein are contemplated. For example, in certain embodiments amino acid sequence variants of anti-BCMA antibodies described herein are contemplated to improve the binding affinity and/or other biological properties of the antibodies. Exemplary method for preparing amino acid variants include, but are not limited to, introducing appropriate modifications into the nucleotide sequence encoding the antibody, or by peptide synthesis. Such modifications include, for example, deletions from, and/or insertions into and/or substitutions of residues within the amino acid sequences of the antibody.

Any combination of deletion, insertion, and substitution can be made to arrive at the final construct, provided that the final construct possesses the desired characteristics, e.g., antigen-binding. In certain embodiments, antibody variants having one or more amino acid substitutions are provided. Sites of interest for substitution mutagenesis include the CDRs and framework regions. Examples of such substitutions are described below. Amino acid substitutions may be introduced into an antibody of interest and the products screened for a desired activity, e.g., retained/improved antigen binding, decreased immunogenicity, or improved T-cell mediated cytotoxicity (TDCC). Both conservative and non-conservative amino acid substitutions are contemplated for preparing the antibody variants.

In another example of a substitution to create a variant anti-BCMA antibody, one or more hypervariable region residues of a parent antibody are substituted. In general, variants are then selected based on improvements in desired properties compared to a parent antibody, for example, increased affinity, reduced affinity, reduced immunogenicity, increased pH dependence of binding.

In some embodiments, the BCMA binding domain of the BCMA targeting trispecific protein is a single domain antibody such as a heavy chain variable domain (VH), a variable domain (VHH) of a llama derived sdAb, a peptide, a ligand or a small molecule entity specific for BCMA. In some embodiments, the BCMA binding domain of the BCMA targeting trispecific protein described herein is any domain that binds to BCMA including but not limited to domains from a monoclonal antibody, a polyclonal antibody, a recombinant antibody, a human antibody, a humanized antibody. In certain embodiments, the BCMA binding domain is a single-domain antibody. In other embodiments, the BCMA binding domain is a peptide. In further embodiments, the BCMA binding domain is a small molecule.

Generally, it should be noted that the term single domain antibody as used herein in its broadest sense is not limited to a specific biological source or to a specific method of preparation. Single domain antibodies are antibodies whose complementary determining regions are part of a single domain polypeptide. Examples include, but are not limited to, heavy chain antibodies, antibodies naturally devoid of light chains, single domain antibodies derived from conventional 4-chain antibodies, engineered antibodies and single domain scaffolds other than those derived from antibodies. Single domain antibodies may be any of the art, or any future single domain antibodies. Single domain antibodies may be derived from any species including, but not limited to mouse, human, camel, llama, goat, rabbit, bovine. For example, in some embodiments, the single domain antibodies of the disclosure are obtained: (1) by isolating the VHH domain of a naturally occurring heavy chain antibody; (2) by expression of a nucleotide sequence encoding a naturally occurring VHH domain; (3) by "humanization" of a naturally occurring VHH domain or by expression of a nucleic acid encoding a such humanized VHH domain; (4) by "camelization" of a naturally occurring VH domain from any animal species, and in particular from a species of mammal, such as from a human being, or by expression of a nucleic acid encoding such a camelized VH domain; (5) by "camelisation" of a "domain antibody" or "Dab", or by expression of a nucleic acid encoding such a camelized VH domain; (6) by using synthetic or semi-synthetic techniques for preparing proteins, polypeptides or other amino acid sequences; (7) by preparing a nucleic acid encoding a single domain antibody using techniques for nucleic acid synthesis known in the field, followed by expression of the nucleic acid thus obtained; and/or (8) by any combination of one or more of the foregoing.

In one embodiment, a single domain antibody corresponds to the VHH domains of naturally occurring heavy chain antibodies directed against BCMA. As further described herein, such VHH sequences can generally be generated or obtained by suitably immunizing a species of Llama with BCMA, (i.e., so as to raise an immune response and/or heavy chain antibodies directed against BCMA), by obtaining a suitable biological sample from said Llama (such as a blood sample, serum sample or sample of B-cells), and by generating VHH sequences directed against BCMA, starting from said sample, using any suitable technique known in the field.

In another embodiment, such naturally occurring VHH domains against BCMA, are obtained from naive libraries of Camelid VHH sequences, for example by screening such a library using BCMA, or at least one part, fragment, antigenic determinant or epitope thereof using one or more screening techniques known in the field. Such libraries and techniques are for example described in WO 99/37681, WO 01/90190, WO 03/025020 and WO 03/035694. Alternatively, improved synthetic or semi-synthetic libraries derived from naive VHH libraries are used, such as VHH libraries obtained from naïve VHH libraries by techniques such as random mutagenesis and/or CDR shuffling, as for example described in WO 00/43507.

In a further embodiment, yet another technique for obtaining VHH sequences directed against BCMA, involves suitably immunizing a transgenic mammal that is capable of expressing heavy chain antibodies (i.e., so as to raise an immune response and/or heavy chain antibodies directed against BCMA), obtaining a suitable biological sample from said transgenic mammal (such as a blood sample, serum sample or sample of B-cells), and then generating VHH sequences directed against BCMA, starting from said sample, using any suitable technique known in the field. For example, for this purpose, the heavy chain antibody-expressing rats or mice and the further methods and techniques described in WO 02/085945 and in WO 04/049794 can be used.

In some embodiments, an anti-BCMA single domain antibody of the BCMA targeting trispecific protein comprises a single domain antibody with an amino acid sequence that corresponds to the amino acid sequence of a naturally occurring VHH domain, but that has been "humanized", i.e., by replacing one or more amino acid residues in the amino acid sequence of said naturally occurring VHH sequence (and in particular in the framework sequences) by one or more of the amino acid residues that occur at the corresponding position(s) in a VH domain from a conventional 4-chain antibody from a human being (e.g., as indicated above). This can be performed in a manner known in the field, which will be clear to the skilled person, for example on the basis of the further description herein. Again, it should be noted that such humanized anti-BCMA single domain antibodies of the disclosure are obtained in any suitable manner known per se (i.e., as indicated under points (1)-(8) above) and thus are not strictly limited to polypeptides that have been obtained using a polypeptide that comprises a naturally occurring VHH domain as a starting material. In some additional embodiments, a single domain anti-BCMA antibody, as described herein, comprises a single domain antibody with an amino acid sequence that corresponds to the amino acid sequence of a naturally occurring VH domain, but that has been "camelized", i.e., by replacing one or more amino acid residues in the amino acid sequence of a naturally occurring VH domain from a conventional 4-chain antibody by one or more of the amino acid residues that occur at the corresponding position(s) in a VHH domain of a heavy chain antibody. Such "camelizing" substitutions are preferably inserted at amino acid positions that form and/or are present at the VH-VL interface, and/or at the so-called Camelidae hallmark residues (see for example WO 94/04678 and Davies and Riechmann (1994 and 1996)). Preferably, the VH sequence that is used as a starting material or starting point for generating or designing the camelized single domain is preferably a VH sequence from a mammal, more preferably the VH sequence of a human being, such as a VH3 sequence. However, it should be noted that such camelized anti-BCMA single domain antibodies of the disclosure, in certain embodiments, are obtained in any suitable manner known in the field (i.e., as indicated under points (1)-(8) above) and thus are not strictly limited to polypeptides that have been obtained using a polypeptide that comprises a naturally occurring VH domain as a starting material. For example, as further described herein, both "humanization" and "camelization" is performed by providing a nucleotide sequence that encodes a naturally occurring VHH domain or VH domain, respectively, and then changing, one or more codons in said nucleotide sequence in such a way that the new nucleotide sequence encodes a "humanized" or "camelized" single domain antibody, respectively. This nucleic acid can then be expressed, so as to provide a desired anti-BCMA single domain antibody of the disclosure. Alternatively, in other embodiments, based on the amino acid sequence of a naturally occurring VHH domain or VH domain, respectively, the amino acid sequence of the desired humanized or camelized anti-BCMA single domain antibody of the disclosure, respectively, are designed and then synthesized de novo using known techniques for peptide synthesis. In some embodiments, based on the amino acid sequence or nucleotide sequence of a naturally occurring VHH domain or VH domain, respectively, a nucleotide sequence encoding the desired humanized or camelized anti-BCMA single domain antibody of the disclosure, respectively, is designed and then synthesized de novo using known techniques for nucleic acid synthesis, after which the nucleic acid thus obtained is expressed in using known expression techniques, so as to provide the desired anti-BCMA single domain antibody of the disclosure.

Other suitable methods and techniques for obtaining the anti-BCMA single domain antibody of the disclosure and/or nucleic acids encoding the same, starting from naturally occurring VH sequences or VHH sequences for example comprises combining one or more parts of one or more naturally occurring VH sequences (such as one or more framework (FR) sequences and/or complementarity determining region (CDR) sequences), one or more parts of one or more naturally occurring VHH sequences (such as one or more FR sequences or CDR sequences), and/or one or more synthetic or semi-synthetic sequences, in a suitable manner, so as to provide an anti-BCMA single domain antibody of the disclosure or a nucleotide sequence or nucleic acid encoding the same.

In some embodiments, the BCMA binding domain is an anti-BCMA specific antibody comprising a heavy chain variable complementarity determining region CDR1, a heavy chain variable CDR2, a heavy chain variable CDR3, a light chain variable CDR1, a light chain variable CDR2, and a light chain variable CDR3. In some embodiments, the BCMA binding domain comprises any domain that binds to BCMA including but not limited to domains from a monoclonal antibody, a polyclonal antibody, a recombinant antibody, a human antibody, a humanized antibody, or antigen binding fragments such as single domain antibodies (sdAb), Fab, Fab', F(ab)2, and Fv fragments, fragments comprised of one or more CDRs, single-chain antibodies (e.g., single chain Fv fragments (scFv)), disulfide stabilized (dsFv) Fv fragments, heteroconjugate antibodies (e.g., bispecific antibodies), pFv fragments, heavy chain monomers or dimers, light chain monomers or dimers, and dimers consisting of one heavy chain and one light chain. In some embodiments, the BCMA binding domain is a single domain antibody. In some embodiments, the anti-BCMA single domain antibody comprises heavy chain variable complementarity determining regions (CDR), CDR1, CDR2, and CDR3.

In some embodiments, the BCMA binding protein of the present disclosure is a polypeptide comprising an amino acid sequence that is comprised of four framework regions/sequences (f1-f4) interrupted by three complementarity determining regions/sequences, as represented by the formula: f1-r1-f2-r2-f3-r3-f4, wherein r1, r2, and r3 are complementarity determining regions CDR1, CDR2, and CDR3, respectively, and f1, f2, f3, and f4 are framework residues. The r1 residues of the BCMA binding protein of the present disclosure comprise, for example, amino acid residues 26, 27, 28, 29, 30, 31, 32, 33 and 34; the r2 residues of the BCMA binding protein of the present disclosure comprise, for example, amino acid residues, for example, 50, 51, 52, 53, 54, 55, 56, 57, 58, 59, 60, 61, 62 and 63; and the r3 residues of the BCMA binding protein of the present disclosure comprise, for example, amino acid residues, for example, 97, 98, 99, 100, 101, 102, 103, 104, 105, 106, 107 and 108. In some embodiments, the BCMA binding protein comprises an amino acid sequence selected from SEQ ID NOs: 346-460.

In one embodiment, the CDR1 does not comprise an amino acid sequence of SEQ ID NO: 599. In one embodiment, the CDR2 does not comprise an amino acid sequence of SEQ ID NO: 600. In one embodiment, the CDR3 does not comprise an amino acid sequence of SEQ ID NO: 601.

In some embodiments, the CDR1 comprises the amino acid sequence as set forth in SEQ ID NO: 1 or a variant thereof having one, two, three, four, five, six, seven, eight, nine, or ten amino acid substitutions. An exemplary CDR1 comprises the amino acid sequence as set forth in SEQ ID NO: 4. Another exemplary CDR1 comprises the amino acid sequence as set forth in SEQ ID NO: 5. Another exemplary CDR1 comprises the amino acid sequence as set forth in SEQ ID NO: 6. Another exemplary CDR1 comprises the amino acid sequence as set forth in SEQ ID NO: 7. Another exemplary CDR1 comprises the amino acid sequence as set forth in SEQ ID NO: 8. Another exemplary CDR1 comprises the amino acid sequence as set forth in SEQ ID NO: 9. Another exemplary CDR1 comprises the amino acid sequence as set forth in SEQ ID NO: 10. Another exemplary CDR1 comprises the amino acid sequence as set forth in SEQ ID NO: 11. Another exemplary CDR1 comprises the amino acid sequence as set forth in SEQ ID NO: 12. Another exemplary CDR1 comprises the amino acid sequence as set forth in SEQ ID NO: 13. Another exemplary CDR1 comprises the amino acid sequence as set forth in SEQ ID NO: 14. Another exemplary CDR1 comprises the amino acid sequence as set forth in SEQ ID NO: 15. Another exemplary CDR1 comprises the amino acid sequence as set forth in SEQ ID NO: 16. Another exemplary CDR1 comprises the amino acid sequence as set forth in SEQ ID NO: 17. Another exemplary CDR1 comprises the amino acid sequence as set forth in SEQ ID NO: 18. Another exemplary CDR1 comprises the amino acid sequence as set forth in SEQ ID NO: 19. Another exemplary CDR1 comprises the amino acid sequence as set forth in SEQ ID NO: 20. Another exemplary CDR1 comprises the amino acid sequence as set forth in SEQ ID NO: 21. Another exemplary CDR1 comprises the amino acid sequence as set forth in SEQ ID NO: 22. Another exemplary CDR1 comprises the amino acid sequence as set forth in SEQ ID NO: 23. Another exemplary CDR1 comprises the amino acid sequence as set forth in SEQ ID NO: 24. Another exemplary CDR1 comprises the amino acid sequence as set forth in SEQ ID NO: 25. Another exemplary CDR1 comprises the amino acid sequence as set forth in SEQ ID NO: 26. Another exemplary CDR1 comprises the amino acid sequence as set forth in SEQ ID NO: 27. Another exemplary CDR1 comprises the amino acid sequence as set forth in SEQ ID NO: 28. Another exemplary CDR1 comprises the amino acid sequence as set forth in SEQ ID NO: 29. Another exemplary CDR1 comprises the amino acid sequence as set forth in SEQ ID NO: 30. Another exemplary CDR1 comprises the amino acid sequence as set forth in SEQ ID NO: 31. Another exemplary CDR1 comprises the amino acid sequence as set forth in SEQ ID NO: 32. Another exemplary CDR1 comprises the amino acid sequence as set forth in SEQ ID NO: 33. Another exemplary CDR1 comprises the amino acid sequence as set forth in SEQ ID NO: 34. Another exemplary CDR1 comprises the amino acid sequence as set forth in SEQ ID NO: 35. Another exemplary CDR1 comprises the amino acid sequence as set forth in SEQ ID NO: 36. Another exemplary CDR1 comprises the amino acid sequence as set forth in SEQ ID NO: 37. Another exemplary CDR1 comprises the amino acid sequence as set forth in SEQ ID NO: 38. Another exemplary CDR1 comprises the amino acid sequence as set forth in SEQ ID NO: 39. Another exemplary CDR1 comprises the amino acid sequence as set forth in SEQ ID NO: 40. Another exemplary CDR1 comprises the amino acid sequence as set forth in SEQ ID NO: 41. Another exemplary CDR1 comprises the amino acid sequence as set forth in SEQ ID NO: 42. Another exemplary CDR1 comprises the amino acid sequence as set forth in SEQ ID NO: 43. Another exemplary CDR1 comprises the amino acid sequence as set forth in SEQ ID NO: 44. Another exemplary CDR1 comprises the amino acid sequence as set forth in SEQ ID NO: 45. Another exemplary CDR1 comprises the amino acid sequence as set forth in SEQ ID NO: 46. Another exemplary CDR1 comprises the amino acid sequence as set forth in SEQ ID NO: 47. Another exemplary CDR1 comprises the amino acid sequence as set forth in SEQ ID NO: 48. Another exemplary CDR1 comprises the amino acid sequence as set forth in SEQ ID NO: 49. Another exemplary CDR1 comprises the amino acid sequence as set forth in SEQ ID NO: 50. Another exemplary CDR1 comprises the amino acid sequence as set forth in SEQ ID NO: 51. Another exemplary CDR1 comprises the amino acid sequence as set forth in SEQ ID NO: 52. Another exemplary CDR1 comprises the amino acid sequence as set forth in SEQ ID NO: 53. Another exemplary CDR1 comprises the amino acid sequence as set forth in SEQ ID NO: 54. Another exemplary CDR1 comprises the amino acid sequence as set forth in SEQ ID NO: 55. Another exemplary CDR1 comprises the amino acid sequence as set forth in SEQ ID NO: 56. Another exemplary CDR1 comprises the amino acid sequence as set forth in SEQ ID NO: 57. Another exemplary CDR1 comprises the amino acid sequence as set forth in SEQ ID NO: 58. Another exemplary CDR1 comprises the amino acid sequence as set forth in SEQ ID NO: 59. Another exemplary CDR1 comprises the amino acid sequence as set forth in SEQ ID NO: 60. Another exemplary CDR1 comprises the amino acid sequence as set forth in SEQ ID NO: 61. Another exemplary CDR1 comprises the amino acid sequence as set forth in SEQ ID NO: 62. Another exemplary CDR1 comprises the amino acid sequence as set forth in SEQ ID NO: 63. Another exemplary CDR1 comprises the amino acid sequence as set forth in SEQ ID NO: 64. Another exemplary CDR1 comprises the amino acid sequence as set forth in SEQ ID NO: 65. Another exemplary CDR1 comprises the amino acid sequence as set forth in SEQ ID NO: 66. Another exemplary CDR1 comprises the amino acid sequence as set forth in SEQ ID NO: 67. Another exemplary CDR1 comprises the amino acid sequence as set forth in SEQ ID NO: 68. Another exemplary CDR1 comprises the amino acid sequence as set forth in SEQ ID NO:

69. Another exemplary CDR1 comprises the amino acid sequence as set forth in SEQ ID NO: 70. Another exemplary CDR1 comprises the amino acid sequence as set forth in SEQ ID NO: 71. Another exemplary CDR1 comprises the amino acid sequence as set forth in SEQ ID NO: 72. Another exemplary CDR1 comprises the amino acid sequence as set forth in SEQ ID NO: 73. Another exemplary CDR1 comprises the amino acid sequence as set forth in SEQ ID NO: 74. Another exemplary CDR1 comprises the amino acid sequence as set forth in SEQ ID NO: 75. Another exemplary CDR1 comprises the amino acid sequence as set forth in SEQ ID NO: 76. Another exemplary CDR1 comprises the amino acid sequence as set forth in SEQ ID NO: 77. Another exemplary CDR1 comprises the amino acid sequence as set forth in SEQ ID NO: 78. Another exemplary CDR1 comprises the amino acid sequence as set forth in SEQ ID NO: 79. Another exemplary CDR1 comprises the amino acid sequence as set forth in SEQ ID NO: 80. Another exemplary CDR1 comprises the amino acid sequence as set forth in SEQ ID NO: 81. Another exemplary CDR1 comprises the amino acid sequence as set forth in SEQ ID NO: 82. Another exemplary CDR1 comprises the amino acid sequence as set forth in SEQ ID NO: 83. Another exemplary CDR1 comprises the amino acid sequence as set forth in SEQ ID NO: 84. Another exemplary CDR1 comprises the amino acid sequence as set forth in SEQ ID NO: 85. Another exemplary CDR1 comprises the amino acid sequence as set forth in SEQ ID NO: 86. Another exemplary CDR1 comprises the amino acid sequence as set forth in SEQ ID NO: 87. Another exemplary CDR1 comprises the amino acid sequence as set forth in SEQ ID NO: 88. Another exemplary CDR1 comprises the amino acid sequence as set forth in SEQ ID NO: 89. Another exemplary CDR1 comprises the amino acid sequence as set forth in SEQ ID NO: 90. Another exemplary CDR1 comprises the amino acid sequence as set forth in SEQ ID NO: 91. Another exemplary CDR1 comprises the amino acid sequence as set forth in SEQ ID NO: 92. Another exemplary CDR1 comprises the amino acid sequence as set forth in SEQ ID NO: 93. Another exemplary CDR1 comprises the amino acid sequence as set forth in SEQ ID NO: 94. Another exemplary CDR1 comprises the amino acid sequence as set forth in SEQ ID NO: 95. Another exemplary CDR1 comprises the amino acid sequence as set forth in SEQ ID NO: 96. Another exemplary CDR1 comprises the amino acid sequence as set forth in SEQ ID NO: 97. Another exemplary CDR1 comprises the amino acid sequence as set forth in SEQ ID NO: 98. Another exemplary CDR1 comprises the amino acid sequence as set forth in SEQ ID NO: 99. Another exemplary CDR1 comprises the amino acid sequence as set forth in SEQ ID NO: 100. Another exemplary CDR1 comprises the amino acid sequence as set forth in SEQ ID NO: 101. Another exemplary CDR1 comprises the amino acid sequence as set forth in SEQ ID NO: 102. Another exemplary CDR1 comprises the amino acid sequence as set forth in SEQ ID NO: 103. Another exemplary CDR1 comprises the amino acid sequence as set forth in SEQ ID NO: 104. Another exemplary CDR1 comprises the amino acid sequence as set forth in SEQ ID NO: 105. Another exemplary CDR1 comprises the amino acid sequence as set forth in SEQ ID NO: 106. Another exemplary CDR1 comprises the amino acid sequence as set forth in SEQ ID NO: 107. Another exemplary CDR1 comprises the amino acid sequence as set forth in SEQ ID NO: 108. Another exemplary CDR1 comprises the amino acid sequence as set forth in SEQ ID NO: 109. Another exemplary CDR1 comprises the amino acid sequence as set forth in SEQ ID NO: 110. Another exemplary CDR1 comprises the amino acid sequence as set forth in SEQ ID NO: 111. Another exemplary CDR1 comprises the amino acid sequence as set forth in SEQ ID NO: 112. Another exemplary CDR1 comprises the amino acid sequence as set forth in SEQ ID NO: 113. Another exemplary CDR1 comprises the amino acid sequence as set forth in SEQ ID NO: 114. Another exemplary CDR1 comprises the amino acid sequence as set forth in SEQ ID NO: 115. Another exemplary CDR1 comprises the amino acid sequence as set forth in SEQ ID NO: 116. Another exemplary CDR1 comprises the amino acid sequence as set forth in SEQ ID NO: 117.

In some embodiments, the CDR2 comprises a sequence as set forth in SEQ ID NO: 2 or a variant having one, two, three, four, five, six, seven, eight, nine, or ten amino acid substitutions in SEQ ID NO: 2. Another exemplary CDR2 comprises the amino acid sequence as set forth in SEQ ID NO: 118. Another exemplary CDR2 comprises the amino acid sequence as set forth in SEQ ID NO: 119. Another exemplary CDR2 comprises the amino acid sequence as set forth in SEQ ID NO: 120. Another exemplary CDR2 comprises the amino acid sequence as set forth in SEQ ID NO: 121. Another exemplary CDR2 comprises the amino acid sequence as set forth in SEQ ID NO: 122. Another exemplary CDR2 comprises the amino acid sequence as set forth in SEQ ID NO: 123. Another exemplary CDR2 comprises the amino acid sequence as set forth in SEQ ID NO: 124. Another exemplary CDR2 comprises the amino acid sequence as set forth in SEQ ID NO: 125. Another exemplary CDR2 comprises the amino acid sequence as set forth in SEQ ID NO: 126. Another exemplary CDR2 comprises the amino acid sequence as set forth in SEQ ID NO: 127. Another exemplary CDR2 comprises the amino acid sequence as set forth in SEQ ID NO: 128. Another exemplary CDR2 comprises the amino acid sequence as set forth in SEQ ID NO: 129. Another exemplary CDR2 comprises the amino acid sequence as set forth in SEQ ID NO: 130. Another exemplary CDR2 comprises the amino acid sequence as set forth in SEQ ID NO: 131. Another exemplary CDR2 comprises the amino acid sequence as set forth in SEQ ID NO: 132. Another exemplary CDR2 comprises the amino acid sequence as set forth in SEQ ID NO: 133. Another exemplary CDR2 comprises the amino acid sequence as set forth in SEQ ID NO: 134. Another exemplary CDR2 comprises the amino acid sequence as set forth in SEQ ID NO: 135. Another exemplary CDR2 comprises the amino acid sequence as set forth in SEQ ID NO: 136. Another exemplary CDR2 comprises the amino acid sequence as set forth in SEQ ID NO: 137. Another exemplary CDR2 comprises the amino acid sequence as set forth in SEQ ID NO: 138. Another exemplary CDR2 comprises the amino acid sequence as set forth in SEQ ID NO: 139. Another exemplary CDR2 comprises the amino acid sequence as set forth in SEQ ID NO: 140. Another exemplary CDR2 comprises the amino acid sequence as set forth in SEQ ID NO: 141. Another exemplary CDR2 comprises the amino acid sequence as set forth in SEQ ID NO: 142. Another exemplary CDR2 comprises the amino acid sequence as set forth in SEQ ID NO: 143. Another exemplary CDR2 comprises the amino acid sequence as set forth in SEQ ID NO: 144. Another exemplary CDR2 comprises the amino acid sequence as set forth in SEQ ID NO: 145. Another exemplary CDR2 comprises the amino acid sequence as set forth in SEQ ID NO: 146. Another exemplary CDR2 comprises the amino acid sequence as set forth in SEQ ID NO: 147. Another exemplary CDR2 comprises the amino acid sequence as set forth in SEQ ID NO: 148. Another exemplary CDR2 comprises the amino acid sequence as set forth in SEQ ID NO: 149. Another exemplary CDR2 comprises the amino acid sequence as set forth in SEQ ID NO: 150. Another exemplary CDR2 comprises the amino acid sequence as set forth in SEQ ID NO: 151. Another exemplary CDR2 comprises the amino acid sequence as set forth in SEQ ID NO: 152. Another exemplary CDR2 comprises the amino acid sequence as set forth in SEQ ID NO: 153. Another exemplary CDR2 comprises the amino acid sequence as set forth in SEQ ID NO: 154. Another exemplary CDR2 comprises the amino acid sequence as set forth in SEQ ID NO: 155. Another exemplary CDR2 comprises the amino acid sequence as set forth in SEQ ID NO: 156. Another exemplary CDR2 comprises the amino acid sequence as set forth in SEQ ID NO: 157. Another exemplary CDR2 comprises the amino acid sequence as set forth in SEQ ID NO: 158. Another exemplary CDR2 comprises the amino acid sequence as set forth in SEQ ID NO: 159. Another exemplary CDR2 comprises the amino acid sequence as set forth in SEQ ID NO: 160. Another exemplary CDR2 comprises the amino acid sequence as set forth in SEQ ID NO: 161. Another exemplary CDR2 comprises the amino acid sequence as set forth in SEQ ID NO: 162. Another exemplary CDR2 comprises the amino acid sequence as set forth in SEQ ID NO: 163. Another exemplary CDR2 comprises the amino acid sequence as set forth in SEQ ID NO: 164. Another exemplary CDR2 comprises the amino acid sequence as set forth in SEQ ID NO: 165. Another exemplary CDR2 comprises the amino acid sequence as set forth in SEQ ID NO: 166. Another exemplary CDR2 comprises the amino acid sequence as set forth in SEQ ID NO: 167. Another exemplary CDR2 comprises the amino acid sequence as set forth in SEQ ID NO: 168. Another exemplary CDR2 comprises the amino acid sequence as set forth in SEQ ID NO: 169. Another exemplary CDR2 comprises the amino acid sequence as set forth in SEQ ID NO: 170. Another exemplary CDR2 comprises the amino acid sequence as set forth in SEQ ID NO: 171. Another exemplary CDR2 comprises the amino acid sequence as set forth in SEQ ID NO: 172. Another exemplary CDR2 comprises the amino acid sequence as set forth in SEQ ID NO: 173. Another exemplary CDR2 comprises the amino acid sequence as set forth in SEQ ID NO: 174. Another exemplary CDR2 comprises the amino acid sequence as set forth in SEQ ID NO: 175. Another exemplary CDR2 comprises the amino acid sequence as set forth in SEQ ID NO: 176. Another exemplary CDR2 comprises the amino acid sequence as set forth in SEQ ID NO: 177. Another exemplary CDR2 comprises the amino acid sequence as set forth in SEQ ID NO: 178. Another exemplary CDR2 comprises the amino acid sequence as set forth in SEQ ID NO: 179. Another exemplary CDR2 comprises the amino acid sequence as set forth in SEQ ID NO: 180. Another exemplary CDR2 comprises the amino acid sequence as set forth in SEQ ID NO: 181. Another exemplary CDR2 comprises the amino acid sequence as set forth in SEQ ID NO: 182. Another exemplary CDR2 comprises the amino acid sequence as set forth in SEQ ID NO: 183. Another exemplary CDR2 comprises the amino acid sequence as set forth in SEQ ID NO: 184. Another exemplary CDR2 comprises the amino acid sequence as set forth in SEQ ID NO: 185. Another exemplary CDR2 comprises the amino acid sequence as set forth in SEQ ID NO: 186. Another exemplary CDR2 comprises the amino acid sequence as set forth in SEQ ID NO: 187. Another exemplary CDR2 comprises the amino acid sequence as set forth in SEQ ID NO: 188. Another exemplary CDR2 comprises the amino acid sequence as set forth in SEQ ID NO: 189. Another exemplary CDR2 comprises the amino acid sequence as set forth in SEQ ID NO: 190. Another exemplary CDR2 comprises the amino acid sequence as set forth in SEQ ID NO: 191. Another exemplary CDR2 comprises the amino acid sequence as set forth in SEQ ID NO: 192. Another exemplary CDR2 comprises the amino acid sequence as set forth in SEQ ID NO: 193. Another exemplary CDR2 comprises the amino acid sequence as set forth in SEQ ID NO: 194. Another exemplary CDR2 comprises the amino acid sequence as set forth in SEQ ID NO: 195. Another exemplary CDR2 comprises the amino acid sequence as set forth in SEQ ID NO: 196. Another exemplary CDR2 comprises the amino acid sequence as set forth in SEQ ID NO: 197. Another exemplary CDR2 comprises the amino acid sequence as set forth in SEQ ID NO: 198. Another exemplary CDR2 comprises the amino acid sequence as set forth in SEQ ID NO: 199. Another exemplary CDR2 comprises the amino acid sequence as set forth in SEQ ID NO: 200. Another exemplary CDR2 comprises the amino acid sequence as set forth in SEQ ID NO: 201. Another exemplary CDR2 comprises the amino acid sequence as set forth in SEQ ID NO: 202. Another exemplary CDR2 comprises the amino acid sequence as set forth in SEQ ID NO: 203. Another exemplary CDR2 comprises the amino acid sequence as set forth in SEQ ID NO: 204. Another exemplary CDR2 comprises the amino acid sequence as set forth in SEQ ID NO: 205. Another exemplary CDR2 comprises the amino acid sequence as set forth in SEQ ID NO: 206. Another exemplary CDR2 comprises the amino acid sequence as set forth in SEQ ID NO: 207. Another exemplary CDR2 comprises the amino acid sequence as set forth in SEQ ID NO: 208. Another exemplary CDR2 comprises the amino acid sequence as set forth in SEQ ID NO: 209. Another exemplary CDR2 comprises the amino acid sequence as set forth in SEQ ID NO: 210. Another exemplary CDR2 comprises the amino acid sequence as set forth in SEQ ID NO: 211. Another exemplary CDR2 comprises the amino acid sequence as set forth in SEQ ID NO: 212. Another exemplary CDR2 comprises the amino acid sequence as set forth in SEQ ID NO: 213. Another exemplary CDR2 comprises the amino acid sequence as set forth in SEQ ID NO: 214. Another exemplary CDR2 comprises the amino acid sequence as set forth in SEQ ID NO: 215. Another exemplary CDR2 comprises the amino acid sequence as set forth in SEQ ID NO: 216. Another exemplary CDR2 comprises the amino acid sequence as set forth in SEQ ID NO: 217. Another exemplary CDR2 comprises the amino acid sequence as set forth in SEQ ID NO: 218. Another exemplary CDR2 comprises the amino acid sequence as set forth in SEQ ID NO: 219. Another exemplary CDR2 comprises the amino acid sequence as set forth in SEQ ID NO: 220. Another exemplary CDR2 comprises the amino acid sequence as set forth in SEQ ID NO: 221. Another exemplary CDR2 comprises the amino acid sequence as set forth in SEQ ID NO: 222. Another exemplary CDR2 comprises the amino acid sequence as set forth in SEQ ID NO: 223. Another exemplary CDR2 comprises the amino acid sequence as set forth in SEQ ID NO: 224. Another exemplary CDR2 comprises the amino acid sequence as set forth in SEQ ID NO: 225. Another exemplary CDR2 comprises the amino acid sequence as set forth in SEQ ID NO: 226. Another exemplary CDR2 comprises the amino acid sequence as set forth in SEQ ID NO: 227. Another exemplary CDR2 comprises the amino acid sequence as set forth in SEQ ID NO: 228. Another exemplary CDR2 comprises the amino acid sequence as set forth in SEQ ID NO: 229.

Another exemplary CDR2 comprises the amino acid sequence as set forth in SEQ ID NO: 230. Another exemplary CDR3 comprises the amino acid sequence as set forth in SEQ ID NO: 231.

In some embodiments, the CDR3 comprises a sequence as set forth in SEQ ID NO: 3 or a variant having one, two, three, four, five, six, seven, eight, nine, or ten amino acid substitutions in SEQ ID NO: 3. Another exemplary CDR3 comprises the amino acid sequence as set forth in SEQ ID NO: 232. Another exemplary CDR3 comprises the amino acid sequence as set forth in SEQ ID NO: 233. Another exemplary CDR3 comprises the amino acid sequence as set forth in SEQ ID NO: 234. Another exemplary CDR3 comprises the amino acid sequence as set forth in SEQ ID NO: 235. Another exemplary CDR3 comprises the amino acid sequence as set forth in SEQ ID NO: 236. Another exemplary CDR3 comprises the amino acid sequence as set forth in SEQ ID NO: 237. Another exemplary CDR3 comprises the amino acid sequence as set forth in SEQ ID NO: 238. Another exemplary CDR3 comprises the amino acid sequence as set forth in SEQ ID NO: 239. Another exemplary CDR3 comprises the amino acid sequence as set forth in SEQ ID NO: 240. Another exemplary CDR3 comprises the amino acid sequence as set forth in SEQ ID NO: 241. Another exemplary CDR3 comprises the amino acid sequence as set forth in SEQ ID NO: 242. Another exemplary CDR3 comprises the amino acid sequence as set forth in SEQ ID NO: 243. Another exemplary CDR3 comprises the amino acid sequence as set forth in SEQ ID NO: 244. Another exemplary CDR3 comprises the amino acid sequence as set forth in SEQ ID NO: 245. Another exemplary CDR3 comprises the amino acid sequence as set forth in SEQ ID NO: 246. Another exemplary CDR3 comprises the amino acid sequence as set forth in SEQ ID NO: 247. Another exemplary CDR3 comprises the amino acid sequence as set forth in SEQ ID NO: 248. Another exemplary CDR3 comprises the amino acid sequence as set forth in SEQ ID NO: 249. Another exemplary CDR3 comprises the amino acid sequence as set forth in SEQ ID NO: 250. Another exemplary CDR3 comprises the amino acid sequence as set forth in SEQ ID NO: 251. Another exemplary CDR3 comprises the amino acid sequence as set forth in SEQ ID NO: 252. Another exemplary CDR3 comprises the amino acid sequence as set forth in SEQ ID NO: 253. Another exemplary CDR3 comprises the amino acid sequence as set forth in SEQ ID NO: 254. Another exemplary CDR3 comprises the amino acid sequence as set forth in SEQ ID NO: 255. Another exemplary CDR3 comprises the amino acid sequence as set forth in SEQ ID NO: 256. Another exemplary CDR3 comprises the amino acid sequence as set forth in SEQ ID NO: 257. Another exemplary CDR3 comprises the amino acid sequence as set forth in SEQ ID NO: 258. Another exemplary CDR3 comprises the amino acid sequence as set forth in SEQ ID NO: 259. Another exemplary CDR3 comprises the amino acid sequence as set forth in SEQ ID NO: 260. Another exemplary CDR3 comprises the amino acid sequence as set forth in SEQ ID NO: 261. Another exemplary CDR3 comprises the amino acid sequence as set forth in SEQ ID NO: 262. Another exemplary CDR3 comprises the amino acid sequence as set forth in SEQ ID NO: 263. Another exemplary CDR3 comprises the amino acid sequence as set forth in SEQ ID NO: 264. Another exemplary CDR3 comprises the amino acid sequence as set forth in SEQ ID NO: 265. Another exemplary CDR3 comprises the amino acid sequence as set forth in SEQ ID NO: 266. Another exemplary CDR3 comprises the amino acid sequence as set forth in SEQ ID NO: 267. Another exemplary CDR3 comprises the amino acid sequence as set forth in SEQ ID NO: 268. Another exemplary CDR3 comprises the amino acid sequence as set forth in SEQ ID NO: 269. Another exemplary CDR3 comprises the amino acid sequence as set forth in SEQ ID NO: 270. Another exemplary CDR3 comprises the amino acid sequence as set forth in SEQ ID NO: 271. Another exemplary CDR3 comprises the amino acid sequence as set forth in SEQ ID NO: 272. Another exemplary CDR3 comprises the amino acid sequence as set forth in SEQ ID NO: 273. Another exemplary CDR3 comprises the amino acid sequence as set forth in SEQ ID NO: 274. Another exemplary CDR3 comprises the amino acid sequence as set forth in SEQ ID NO: 275. Another exemplary CDR3 comprises the amino acid sequence as set forth in SEQ ID NO: 276. Another exemplary CDR3 comprises the amino acid sequence as set forth in SEQ ID NO: 277. Another exemplary CDR3 comprises the amino acid sequence as set forth in SEQ ID NO: 278. Another exemplary CDR3 comprises the amino acid sequence as set forth in SEQ ID NO: 279. Another exemplary CDR3 comprises the amino acid sequence as set forth in SEQ ID NO: 280. Another exemplary CDR3 comprises the amino acid sequence as set forth in SEQ ID NO: 281. Another exemplary CDR3 comprises the amino acid sequence as set forth in SEQ ID NO: 282. Another exemplary CDR3 comprises the amino acid sequence as set forth in SEQ ID NO: 283. Another exemplary CDR3 comprises the amino acid sequence as set forth in SEQ ID NO: 284. Another exemplary CDR3 comprises the amino acid sequence as set forth in SEQ ID NO: 285. Another exemplary CDR3 comprises the amino acid sequence as set forth in SEQ ID NO: 286. Another exemplary CDR3 comprises the amino acid sequence as set forth in SEQ ID NO: 287. Another exemplary CDR3 comprises the amino acid sequence as set forth in SEQ ID NO: 288. Another exemplary CDR3 comprises the amino acid sequence as set forth in SEQ ID NO: 289. Another exemplary CDR3 comprises the amino acid sequence as set forth in SEQ ID NO: 290. Another exemplary CDR3 comprises the amino acid sequence as set forth in SEQ ID NO: 291. Another exemplary CDR3 comprises the amino acid sequence as set forth in SEQ ID NO: 292. Another exemplary CDR3 comprises the amino acid sequence as set forth in SEQ ID NO: 293. Another exemplary CDR3 comprises the amino acid sequence as set forth in SEQ ID NO: 294. Another exemplary CDR3 comprises the amino acid sequence as set forth in SEQ ID NO: 295. Another exemplary CDR3 comprises the amino acid sequence as set forth in SEQ ID NO: 296. Another exemplary CDR3 comprises the amino acid sequence as set forth in SEQ ID NO: 297. Another exemplary CDR3 comprises the amino acid sequence as set forth in SEQ ID NO: 298. Another exemplary CDR3 comprises the amino acid sequence as set forth in SEQ ID NO: 299. Another exemplary CDR3 comprises the amino acid sequence as set forth in SEQ ID NO: 300. Another exemplary CDR3 comprises the amino acid sequence as set forth in SEQ ID NO: 301. Another exemplary CDR3 comprises the amino acid sequence as set forth in SEQ ID NO: 302. Another exemplary CDR3 comprises the amino acid sequence as set forth in SEQ ID NO: 303. Another exemplary CDR3 comprises the amino acid sequence as set forth in SEQ ID NO: 304. Another exemplary CDR3 comprises the amino acid sequence as set forth in SEQ ID NO: 305. Another exemplary CDR3 comprises the amino acid sequence as set forth in SEQ ID NO: 306. Another exemplary CDR3 comprises the amino acid sequence as set forth in SEQ ID NO: 307.

Another exemplary CDR3 comprises the amino acid sequence as set forth in SEQ ID NO: 308. Another exemplary CDR3 comprises the amino acid sequence as set forth in SEQ ID NO: 309. Another exemplary CDR3 comprises the amino acid sequence as set forth in SEQ ID NO: 310. Another exemplary CDR3 comprises the amino acid sequence as set forth in SEQ ID NO: 311. Another exemplary CDR3 comprises the amino acid sequence as set forth in SEQ ID NO: 312. Another exemplary CDR3 comprises the amino acid sequence as set forth in SEQ ID NO: 313. Another exemplary CDR3 comprises the amino acid sequence as set forth in SEQ ID NO: 314. Another exemplary CDR3 comprises the amino acid sequence as set forth in SEQ ID NO: 315. Another exemplary CDR3 comprises the amino acid sequence as set forth in SEQ ID NO: 316. Another exemplary CDR3 comprises the amino acid sequence as set forth in SEQ ID NO: 317. Another exemplary CDR3 comprises the amino acid sequence as set forth in SEQ ID NO: 318. Another exemplary CDR3 comprises the amino acid sequence as set forth in SEQ ID NO: 319. Another exemplary CDR3 comprises the amino acid sequence as set forth in SEQ ID NO: 320. Another exemplary CDR3 comprises the amino acid sequence as set forth in SEQ ID NO: 321. Another exemplary CDR3 comprises the amino acid sequence as set forth in SEQ ID NO: 322. Another exemplary CDR3 comprises the amino acid sequence as set forth in SEQ ID NO: 323. Another exemplary CDR3 comprises the amino acid sequence as set forth in SEQ ID NO: 324. Another exemplary CDR3 comprises the amino acid sequence as set forth in SEQ ID NO: 325. Another exemplary CDR3 comprises the amino acid sequence as set forth in SEQ ID NO: 326. Another exemplary CDR3 comprises the amino acid sequence as set forth in SEQ ID NO: 327. Another exemplary CDR3 comprises the amino acid sequence as set forth in SEQ ID NO: 328. Another exemplary CDR3 comprises the amino acid sequence as set forth in SEQ ID NO: 329. Another exemplary CDR3 comprises the amino acid sequence as set forth in SEQ ID NO: 330. Another exemplary CDR3 comprises the amino acid sequence as set forth in SEQ ID NO: 331. Another exemplary CDR3 comprises the amino acid sequence as set forth in SEQ ID NO: 332. Another exemplary CDR3 comprises the amino acid sequence as set forth in SEQ ID NO: 333. Another exemplary CDR3 comprises the amino acid sequence as set forth in SEQ ID NO: 334. Another exemplary CDR3 comprises the amino acid sequence as set forth in SEQ ID NO: 335. Another exemplary CDR3 comprises the amino acid sequence as set forth in SEQ ID NO: 336. Another exemplary CDR3 comprises the amino acid sequence as set forth in SEQ ID NO: 337. Another exemplary CDR3 comprises the amino acid sequence as set forth in SEQ ID NO: 338. Another exemplary CDR3 comprises the amino acid sequence as set forth in SEQ ID NO: 339. Another exemplary CDR3 comprises the amino acid sequence as set forth in SEQ ID NO: 340. Another exemplary CDR3 comprises the amino acid sequence as set forth in SEQ ID NO: 341. Another exemplary CDR3 comprises the amino acid sequence as set forth in SEQ ID NO: 342. Another exemplary CDR3 comprises the amino acid sequence as set forth in SEQ ID NO: 343. Another exemplary CDR3 comprises the amino acid sequence as set forth in SEQ ID NO: 344. Another exemplary CDR3 comprises the amino acid sequence as set forth in SEQ ID NO: 345.

In various embodiments, the BCMA binding protein of the present disclosure has a CDR1 that has an amino acid sequence that is at least about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to an amino acid sequence selected from SEQ ID NOs: 4-117.

In various embodiments, the BCMA binding protein of the present disclosure has a CDR2 that has an amino acid sequence that is at least about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to an amino acid sequence selected from SEQ ID NOs: 118-231.

In various embodiments, a complementarity determining region of the BCMA binding protein of the present disclosure has a CDR3 that has an amino acid sequence that is at least about 10%, about 20%, about 30%, about 40%, about 50%, about 60%, about 70%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to an amino acid sequence selected from SEQ ID NOs: 232-345.

In various embodiments, a BCMA binding protein of the present disclosure has an amino acid sequence that is at least about 10%, about 20%, about 30%, about 40%, about 50%, about 60%, about 70%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to an amino acid sequence selected from SEQ ID NOs: 346-460.

In various embodiments, a BCMA binding protein of the present disclosure has a framework 1 (f1) that has an amino acid sequence that is at least about 10, about 20%, about 30%, about 40%, about 50%, about 60%, about 70%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to the amino acid sequence set forth in SEQ ID NO: 461 or SEQ ID NO: 462.

In various embodiments, a BCMA binding protein of the present disclosure has a framework 2 (f2) that has an amino acid sequence that is at least about 10%, about 20%, about 30%, about 40%, about 50%, about 60%, about 70%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to the amino acid sequence set forth in SEQ ID NO: 463.

In various embodiments, a BCMA binding protein of the present disclosure has a framework 3 (f3) that has an amino acid sequence that is at least about 10%, about 20%, about 30%, about 40%, about 50%, about 60%, about 70%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to the amino acid sequence set forth in SEQ ID NO: 464 or SEQ ID NO: 465.

In various embodiments, a BCMA binding protein of the present disclosure has a framework 4 (f4) that has an amino acid sequence that is at least about 10%, about 20%, about 30%, about 40%, about 50%, about 60%, about 70%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to the amino acid sequence set forth in SEQ ID NO: 466 or SEQ ID NO: 467.

In some embodiments, the BCMA binding protein is a single domain antibody comprising the sequence of SEQ ID NO: 346. In some embodiments, the BCMA binding protein is a single domain antibody comprising the sequence of SEQ ID NO: 347. In some embodiments, the BCMA binding protein is a single domain antibody comprising the sequence of SEQ ID NO: 348. In some embodiments, the BCMA binding protein is a single domain antibody comprising the sequence of SEQ ID NO: 349. In some embodiments, the BCMA binding protein is a single domain antibody comprising the sequence of SEQ ID NO: 350. In some embodiments, the BCMA binding protein is a single domain antibody comprising the sequence of SEQ ID NO: 351. In some embodiments, the BCMA binding protein is a single domain antibody comprising the sequence of SEQ ID NO: 352. In some embodiments, the BCMA binding protein is a single domain antibody comprising the sequence of SEQ ID NO: 353. In some embodiments, the BCMA binding protein is a single domain antibody comprising the sequence of SEQ ID NO: 354. In some embodiments, the BCMA binding protein is a single domain antibody comprising the sequence of SEQ ID NO: 355. In some embodiments, the BCMA binding protein is a single domain antibody comprising the sequence of SEQ ID NO: 356. In some embodiments, the BCMA binding protein is a single domain antibody comprising the sequence of SEQ ID NO: 357. In some embodiments, the BCMA binding protein is a single domain antibody comprising the sequence of SEQ ID NO: 358. In some embodiments, the BCMA binding protein is a single domain antibody comprising the sequence of SEQ ID NO: 359.

In some embodiments, the BCMA binding protein is a single domain antibody comprising the sequence of SEQ ID NO: 360. In some embodiments, the BCMA binding protein is a single domain antibody comprising the sequence of SEQ ID NO: 361. In some embodiments, the BCMA binding protein is a single domain antibody comprising the sequence of SEQ ID NO: 362. In some embodiments, the BCMA binding protein is a single domain antibody comprising the sequence of SEQ ID NO: 363. In some embodiments, the BCMA binding protein is a single domain antibody comprising the sequence of SEQ ID NO: 364. In some embodiments, the BCMA binding protein is a single domain antibody comprising the sequence of SEQ ID NO: 365. In some embodiments, the BCMA binding protein is a single domain antibody comprising the sequence of SEQ ID NO: 366. In some embodiments, the BCMA binding protein is a single domain antibody comprising the sequence of SEQ ID NO: 367. In some embodiments, the BCMA binding protein is a single domain antibody comprising the sequence of SEQ ID NO: 368. In some embodiments, the BCMA binding protein is a single domain antibody comprising the sequence of SEQ ID NO: 369.

In some embodiments, the BCMA binding protein is a single domain antibody comprising the sequence of SEQ ID NO: 370. In some embodiments, the BCMA binding protein is a single domain antibody comprising the sequence of SEQ ID NO: 371. In some embodiments, the BCMA binding protein is a single domain antibody comprising the sequence of SEQ ID NO: 372. In some embodiments, the BCMA binding protein is a single domain antibody comprising the sequence of SEQ ID NO: 373. In some embodiments, the BCMA binding protein is a single domain antibody comprising the sequence of SEQ ID NO: 374. In some embodiments, the BCMA binding protein is a single domain antibody comprising the sequence of SEQ ID NO: 375. In some embodiments, the BCMA binding protein is a single domain antibody comprising the sequence of SEQ ID NO: 376. In some embodiments, the BCMA binding protein is a single domain antibody comprising the sequence of SEQ ID NO: 377. In some embodiments, the BCMA binding protein is a single domain antibody comprising the sequence of SEQ ID NO: 378. In some embodiments, the BCMA binding protein is a single domain antibody comprising the sequence of SEQ ID NO: 379.

In some embodiments, the BCMA binding protein is a single domain antibody comprising the sequence of SEQ ID NO: 380. In some embodiments, the BCMA binding protein is a single domain antibody comprising the sequence of SEQ ID NO: 381. In some embodiments, the BCMA binding protein is a single domain antibody comprising the sequence of SEQ ID NO: 382. In some embodiments, the BCMA binding protein is a single domain antibody comprising the sequence of SEQ ID NO: 383. In some embodiments, the BCMA binding protein is a single domain antibody comprising the sequence of SEQ ID NO: 384. In some embodiments, the BCMA binding protein is a single domain antibody comprising the sequence of SEQ ID NO: 385. In some embodiments, the BCMA binding protein is a single domain antibody comprising the sequence of SEQ ID NO: 386. In some embodiments, the BCMA binding protein is a single domain antibody comprising the sequence of SEQ ID NO: 387. In some embodiments, the BCMA binding protein is a single domain antibody comprising the sequence of SEQ ID NO: 388. In some embodiments, the BCMA binding protein is a single domain antibody comprising the sequence of SEQ ID NO: 389.

In some embodiments, the BCMA binding protein is a single domain antibody comprising the sequence of SEQ ID NO: 390. In some embodiments, the BCMA binding protein is a single domain antibody comprising the sequence of SEQ ID NO: 391. In some embodiments, the BCMA binding protein is a single domain antibody comprising the sequence of SEQ ID NO: 392. In some embodiments, the BCMA binding protein is a single domain antibody comprising the sequence of SEQ ID NO: 393. In some embodiments, the BCMA binding protein is a single domain antibody comprising the sequence of SEQ ID NO: 394. In some embodiments, the BCMA binding protein is a single domain antibody comprising the sequence of SEQ ID NO: 395. In some embodiments, the BCMA binding protein is a single domain antibody comprising the sequence of SEQ ID NO: 396. In some embodiments, the BCMA binding protein is a single domain antibody comprising the sequence of SEQ ID NO: 397. In some embodiments, the BCMA binding protein is a single domain antibody comprising the sequence of SEQ ID NO: 398. In some embodiments, the BCMA binding protein is a single domain antibody comprising the sequence of SEQ ID NO: 399.

In some embodiments, the BCMA binding protein is a single domain antibody comprising the sequence of SEQ ID NO: 400. In some embodiments, the BCMA binding protein is a single domain antibody comprising the sequence of SEQ ID NO: 401. In some embodiments, the BCMA binding protein is a single domain antibody comprising the sequence of SEQ ID NO: 402. In some embodiments, the BCMA binding protein is a single domain antibody comprising the sequence of SEQ ID NO: 403. In some embodiments, the BCMA binding protein is a single domain antibody comprising the sequence of SEQ ID NO: 404. In some embodiments, the BCMA binding protein is a single domain antibody comprising the sequence of SEQ ID NO: 405. In some embodiments, the BCMA binding protein is a single domain antibody comprising the sequence of SEQ ID NO: 406. In some embodiments, the BCMA binding protein is a single domain antibody comprising the sequence of SEQ ID NO: 407. In some embodiments, the BCMA binding protein is a single domain antibody comprising the sequence of SEQ ID NO: 408. In some embodiments, the BCMA binding protein is a single domain antibody comprising the sequence of SEQ ID NO: 409.

In some embodiments, the BCMA binding protein is a single domain antibody comprising the sequence of SEQ ID NO: 410. In some embodiments, the BCMA binding protein is a single domain antibody comprising the sequence of SEQ ID NO: 411. In some embodiments, the BCMA binding protein is a single domain antibody comprising the sequence of SEQ ID NO: 412. In some embodiments, the BCMA binding protein is a single domain antibody comprising the sequence of SEQ ID NO: 413. In some embodiments, the BCMA binding protein is a single domain antibody comprising the sequence of SEQ ID NO: 414. In some embodiments, the BCMA binding protein is a single domain antibody comprising the sequence of SEQ ID NO: 415. In some embodiments, the BCMA binding protein is a single domain antibody comprising the sequence of SEQ ID NO: 416. In some embodiments, the BCMA binding protein is a single domain antibody comprising the sequence of SEQ ID NO: 417. In some embodiments, the BCMA binding protein is a single domain antibody comprising the sequence of SEQ ID NO: 418. In some embodiments, the BCMA binding protein is a single domain antibody comprising the sequence of SEQ ID NO: 419.

In some embodiments, the BCMA binding protein is a single domain antibody comprising the sequence of SEQ ID NO: 420. In some embodiments, the BCMA binding protein is a single domain antibody comprising the sequence of SEQ ID NO: 421. In some embodiments, the BCMA binding protein is a single domain antibody comprising the sequence of SEQ ID NO: 422. In some embodiments, the BCMA binding protein is a single domain antibody comprising the sequence of SEQ ID NO: 423. In some embodiments, the BCMA binding protein is a single domain antibody comprising the sequence of SEQ ID NO: 424. In some embodiments, the BCMA binding protein is a single domain antibody comprising the sequence of SEQ ID NO: 425. In some embodiments, the BCMA binding protein is a single domain antibody comprising the sequence of SEQ ID NO: 426. In some embodiments, the BCMA binding protein is a single domain antibody comprising the sequence of SEQ ID NO: 427. In some embodiments, the BCMA binding protein is a single domain antibody comprising the sequence of SEQ ID NO: 428. In some embodiments, the BCMA binding protein is a single domain antibody comprising the sequence of SEQ ID NO: 429.

In some embodiments, the BCMA binding protein is a single domain antibody comprising the sequence of SEQ ID NO: 430. In some embodiments, the BCMA binding protein is a single domain antibody comprising the sequence of SEQ ID NO: 431. In some embodiments, the BCMA binding protein is a single domain antibody comprising the sequence of SEQ ID NO: 432. In some embodiments, the BCMA binding protein is a single domain antibody comprising the sequence of SEQ ID NO: 433. In some embodiments, the BCMA binding protein is a single domain antibody comprising the sequence of SEQ ID NO: 434. In some embodiments, the BCMA binding protein is a single domain antibody comprising the sequence of SEQ ID NO: 435. In some embodiments, the BCMA binding protein is a single domain antibody comprising the sequence of SEQ ID NO: 436. In some embodiments, the BCMA binding protein is a single domain antibody comprising the sequence of SEQ ID NO: 437. In some embodiments, the BCMA binding protein is a single domain antibody comprising the sequence of SEQ ID NO: 438. In some embodiments, the BCMA binding protein is a single domain antibody comprising the sequence of SEQ ID NO: 439.

In some embodiments, the BCMA binding protein is a single domain antibody comprising the sequence of SEQ ID NO: 440. In some embodiments, the BCMA binding protein is a single domain antibody comprising the sequence of SEQ ID NO: 441. In some embodiments, the BCMA binding protein is a single domain antibody comprising the sequence of SEQ ID NO: 442. In some embodiments, the BCMA binding protein is a single domain antibody comprising the sequence of SEQ ID NO: 443. In some embodiments, the BCMA binding protein is a single domain antibody comprising the sequence of SEQ ID NO: 444. In some embodiments, the BCMA binding protein is a single domain antibody comprising the sequence of SEQ ID NO: 445. In some embodiments, the BCMA binding protein is a single domain antibody comprising the sequence of SEQ ID NO: 446.

In some embodiments, the BCMA binding protein is a single domain antibody comprising the sequence of SEQ ID NO: 447. In some embodiments, the BCMA binding protein is a single domain antibody comprising the sequence of SEQ ID NO: 448. In some embodiments, the BCMA binding protein is a single domain antibody comprising the sequence of SEQ ID NO: 449.

In some embodiments, the BCMA binding protein is a single domain antibody comprising the sequence of SEQ ID NO: 450. In some embodiments, the BCMA binding protein is a single domain antibody comprising the sequence of SEQ ID NO: 451. In some embodiments, the BCMA binding protein is a single domain antibody comprising the sequence of SEQ ID NO: 452. In some embodiments, the BCMA binding protein is a single domain antibody comprising the sequence of SEQ ID NO: 453. In some embodiments, the BCMA binding protein is a single domain antibody comprising the sequence of SEQ ID NO: 454. In some embodiments, the BCMA binding protein is a single domain antibody comprising the sequence of SEQ ID NO: 455. In some embodiments, the BCMA binding protein is a single domain antibody comprising the sequence of SEQ ID NO: 456. In some embodiments, the BCMA binding protein is a single domain antibody comprising the sequence of SEQ ID NO: 457. In some embodiments, the BCMA binding protein is a single domain antibody comprising the sequence of SEQ ID NO: 458. In some embodiments, the BCMA binding protein is a single domain antibody comprising the sequence of SEQ ID NO: 459. In some embodiments, the BCMA binding protein is a single domain antibody comprising the sequence of SEQ ID NO: 460.

A BCMA binding protein described herein can bind to human BCMA with a hKd ranges from about 0.1 nM to about 500 nM. In some embodiments, the hKd ranges from about 0.1 nM to about 450 nM. In some embodiments, the hKd ranges from about 0.1 nM to about 400 nM. In some embodiments, the hKd ranges from about 0.1 nM to about 350 nM. In some embodiments, the hKd ranges from about 0.1 nM to about 300 nM. In some embodiments, the hKd ranges from about 0.1 nM to about 250 nM. In some embodiments, the hKd ranges from about 0.1 nM to about 200 nM. In some embodiments, the hKd ranges from about 0.1 nM to about 150 nM. In some embodiments, the hKd ranges from about 0.1 nM to about 100 nM. In some embodiments, the hKd ranges from about 0.1 nM to about 90 nM. In some embodiments, the hKd ranges from about 0.2 nM to about 80 nM. In some embodiments, the hKd ranges from about 0.3 nM to about 70 nM. In some embodiments, the hKd ranges from about 0.4 nM to about 50 nM. In some embodiments, the hKd ranges from about 0.5 nM to about 30 nM. In some embodiments, the hKd ranges from about 0.6 nM to about 10 nM. In some embodiments, the hKd ranges from about 0.7 nM to about 8 nM. In some embodiments, the hKd ranges from about 0.8 nM to about 6 nM. In some embodiments, the hKd ranges from about 0.9 nM to about 4 nM. In some embodiments, the hKd ranges from about 1 nM to about 2 nM.

In some embodiments, any of the foregoing BCMA binding domains are affinity peptide tagged for ease of purification. In some embodiments, the affinity peptide tag is six consecutive histidine residues, also referred to as a His tag or 6×-his (His-His-His-His-His-His; SEQ ID NO: 471).

In certain embodiments, the BCMA binding domains of the present disclosure preferentially bind membrane bound BCMA over soluble BCMA. Membrane bound BCMA refers to the presence of BCMA in or on the cell membrane surface of a cell that expresses BCMA. Soluble BCMA refers to BCMA that is no longer on in or on the cell membrane surface of a cell that expresses or expressed BCMA. In certain instances, the soluble BCMA is present in the blood and/or lymphatic circulation in a subject. In one embodiment, the BCMA binding domains bind membrane-bound BCMA at least 5 fold, 10 fold, 15 fold, 20 fold, 25 fold, 30 fold, 40 fold, 50 fold, 100 fold, 500 fold, or 1000 fold greater than soluble BCMA. In one embodiment, the BCMA targeting trispecific antigen binding proteins of the present disclosure preferentially bind membrane-bound BCMA 30 fold greater than soluble BCMA. Determining the preferential binding of an antigen binding protein to membrane bound BCMA over soluble BCMA can be readily determined using assays well known in the art.

Trispecific Proteins

A BCMA binding trispecific protein comprises an amino acid sequence selected from the group consisting of SEQ ID NO: 483-597.

In one example, a BCMA binding trispecific protein comprises an amino acid sequence of SEQ ID NO: 483. In one example, a BCMA binding trispecific protein comprises an amino acid sequence of SEQ ID NO: 484. In one example, a BCMA binding trispecific protein comprises an amino acid sequence of SEQ ID NO: 485. In one example, a BCMA binding trispecific protein comprises an amino acid sequence of SEQ ID NO: 486. In one example, a BCMA binding trispecific protein comprises an amino acid sequence of SEQ ID NO: 487. In one example, a BCMA binding trispecific protein comprises an amino acid sequence of SEQ ID NO: 488. In one example, a BCMA binding trispecific protein comprises an amino acid sequence of SEQ ID NO: 489. In one example, a BCMA binding trispecific protein comprises an amino acid sequence of SEQ ID NO: 490. In one example, a BCMA binding trispecific protein comprises an amino acid sequence of SEQ ID NO: 491. In one example, a BCMA binding trispecific protein comprises an amino acid sequence of SEQ ID NO: 492. In one example, a BCMA binding trispecific protein comprises an amino acid sequence of SEQ ID NO: 493. In one example, a BCMA binding trispecific protein comprises an amino acid sequence of SEQ ID NO: 494. In one example, a BCMA binding trispecific protein comprises an amino acid sequence of SEQ ID NO: 495. In one example, a BCMA binding trispecific protein comprises an amino acid sequence of SEQ ID NO: 496. In one example, a BCMA binding trispecific protein comprises an amino acid sequence of SEQ ID NO: 497. In one example, a BCMA binding trispecific protein comprises an amino acid sequence of SEQ ID NO: 498. In one example, a BCMA binding trispecific protein comprises an amino acid sequence of SEQ ID NO: 499.

In one example, a BCMA binding trispecific protein comprises an amino acid sequence of SEQ ID NO: 500. In one example, a BCMA binding trispecific protein comprises an amino acid sequence of SEQ ID NO: 501. In one example, a BCMA binding trispecific protein comprises an amino acid sequence of SEQ ID NO: 502. In one example, a BCMA binding trispecific protein comprises an amino acid sequence of SEQ ID NO: 503. In one example, a BCMA binding trispecific protein comprises an amino acid sequence of SEQ ID NO: 504. In one example, a BCMA binding trispecific protein comprises an amino acid sequence of SEQ ID NO: 505. In one example, a BCMA binding trispecific protein comprises an amino acid sequence of SEQ ID NO: 506. In one example, a BCMA binding trispecific protein comprises an amino acid sequence of SEQ ID NO: 507. In one example, a BCMA binding trispecific protein comprises an amino acid sequence of SEQ ID NO: 508. In one example, a BCMA binding trispecific protein comprises an amino acid sequence of SEQ ID NO: 509.

In one example, a BCMA binding trispecific protein comprises an amino acid sequence of SEQ ID NO: 510. In one example, a BCMA binding trispecific protein comprises an amino acid sequence of SEQ ID NO: 511. In one example, a BCMA binding trispecific protein comprises an amino acid sequence of SEQ ID NO: 512. In one example, a BCMA binding trispecific protein comprises an amino acid sequence of SEQ ID NO: 513. In one example, a BCMA binding trispecific protein comprises an amino acid sequence of SEQ ID NO: 514. In one example, a BCMA binding trispecific protein comprises an amino acid sequence of SEQ ID NO: 515. In one example, a BCMA binding trispecific protein comprises an amino acid sequence of SEQ ID NO: 516. In one example, a BCMA binding trispecific protein comprises an amino acid sequence of SEQ ID NO: 517. In one example, a BCMA binding trispecific protein comprises an amino acid sequence of SEQ ID NO: 518. In one example, a BCMA binding trispecific protein comprises an amino acid sequence of SEQ ID NO: 519.

In one example, a BCMA binding trispecific protein comprises an amino acid sequence of SEQ ID NO: 520. In one example, a BCMA binding trispecific protein comprises an amino acid sequence of SEQ ID NO: 521. In one example, a BCMA binding trispecific protein comprises an amino acid sequence of SEQ ID NO: 522. In one example, a BCMA binding trispecific protein comprises an amino acid sequence of SEQ ID NO: 523. In one example, a BCMA binding trispecific protein comprises an amino acid sequence of SEQ ID NO: 524. In one example, a BCMA binding trispecific protein comprises an amino acid sequence of SEQ ID NO: 525. In one example, a BCMA binding trispecific protein comprises an amino acid sequence of SEQ ID NO: 526. In one example, a BCMA binding trispecific protein comprises an amino acid sequence of SEQ ID NO: 527. In one example, a BCMA binding trispecific protein comprises an amino acid sequence of SEQ ID NO: 528. In one example, a BCMA binding trispecific protein comprises an amino acid sequence of SEQ ID NO: 529.

In one example, a BCMA binding trispecific protein comprises an amino acid sequence of SEQ ID NO: 530. In one example, a BCMA binding trispecific protein comprises an amino acid sequence of SEQ ID NO: 531. In one example, a BCMA binding trispecific protein comprises an amino acid sequence of SEQ ID NO: 532. In one example, a BCMA binding trispecific protein comprises an amino acid sequence of SEQ ID NO: 533. In one example, a BCMA binding trispecific protein comprises an amino acid sequence of SEQ ID NO: 534. In one example, a BCMA binding trispecific protein comprises an amino acid sequence of SEQ ID NO: 535. In one example, a BCMA binding trispecific protein comprises an amino acid sequence of SEQ ID NO: 536. In one example, a BCMA binding trispecific protein comprises an amino acid sequence of SEQ ID NO: 537. In one example, a BCMA binding trispecific protein comprises an amino acid sequence of SEQ ID NO: 538. In one example, a BCMA binding trispecific protein comprises an amino acid sequence of SEQ ID NO: 539. In one example, a BCMA binding trispecific protein comprises an amino acid sequence of SEQ ID NO: 540.

In one example, a BCMA binding trispecific protein comprises an amino acid sequence of SEQ ID NO: 541. In one example, a BCMA binding trispecific protein comprises an amino acid sequence of SEQ ID NO: 542. In one example, a BCMA binding trispecific protein comprises an amino acid sequence of SEQ ID NO: 543. In one example, a BCMA binding trispecific protein comprises an amino acid sequence of SEQ ID NO: 544. In one example, a BCMA binding trispecific protein comprises an amino acid sequence of SEQ ID NO: 545. In one example, a BCMA binding trispecific protein comprises an amino acid sequence of SEQ ID NO: 546. In one example, a BCMA binding trispecific protein comprises an amino acid sequence of SEQ ID NO: 547. In one example, a BCMA binding trispecific protein comprises an amino acid sequence of SEQ ID NO: 5048. In one example, a BCMA binding trispecific protein comprises an amino acid sequence of SEQ ID NO: 549. In one example, a BCMA binding trispecific protein comprises an amino acid sequence of SEQ ID NO: 550.

In one example, a BCMA binding trispecific protein comprises an amino acid sequence of SEQ ID NO: 551. In one example, a BCMA binding trispecific protein comprises an amino acid sequence of SEQ ID NO: 552. In one example, a BCMA binding trispecific protein comprises an amino acid sequence of SEQ ID NO: 553. In one example, a BCMA binding trispecific protein comprises an amino acid sequence of SEQ ID NO: 554. In one example, a BCMA binding trispecific protein comprises an amino acid sequence of SEQ ID NO: 555. In one example, a BCMA binding trispecific protein comprises an amino acid sequence of SEQ ID NO: 556. In one example, a BCMA binding trispecific protein comprises an amino acid sequence of SEQ ID NO: 557. In one example, a BCMA binding trispecific protein comprises an amino acid sequence of SEQ ID NO: 558. In one example, a BCMA binding trispecific protein comprises an amino acid sequence of SEQ ID NO: 559.

In one example, a BCMA binding trispecific protein comprises an amino acid sequence of SEQ ID NO: 560. In one example, a BCMA binding trispecific protein comprises an amino acid sequence of SEQ ID NO: 561. In one example, a BCMA binding trispecific protein comprises an amino acid sequence of SEQ ID NO: 562. In one example, a BCMA binding trispecific protein comprises an amino acid sequence of SEQ ID NO: 563. In one example, a BCMA binding trispecific protein comprises an amino acid sequence of SEQ ID NO: 564. In one example, a BCMA binding trispecific protein comprises an amino acid sequence of SEQ ID NO: 565. In one example, a BCMA binding trispecific protein comprises an amino acid sequence of SEQ ID NO: 566. In one example, a BCMA binding trispecific protein comprises an amino acid sequence of SEQ ID NO: 567. In one example, a BCMA binding trispecific protein comprises an amino acid sequence of SEQ ID NO: 568. In one example, a BCMA binding trispecific protein comprises an amino acid sequence of SEQ ID NO: 569.

In one example, a BCMA binding trispecific protein comprises an amino acid sequence of SEQ ID NO: 570. In one example, a BCMA binding trispecific protein comprises an amino acid sequence of SEQ ID NO: 571. In one example, a BCMA binding trispecific protein comprises an amino acid sequence of SEQ ID NO: 572. In one example, a BCMA binding trispecific protein comprises an amino acid sequence of SEQ ID NO: 573. In one example, a BCMA binding trispecific protein comprises an amino acid sequence of SEQ ID NO: 574. In one example, a BCMA binding trispecific protein comprises an amino acid sequence of SEQ ID NO: 575. In one example, a BCMA binding trispecific protein comprises an amino acid sequence of SEQ ID NO: 576. In one example, a BCMA binding trispecific protein comprises an amino acid sequence of SEQ ID NO: 577. In one example, a BCMA binding trispecific protein comprises an amino acid sequence of SEQ ID NO: 578. In one example, a BCMA binding trispecific protein comprises an amino acid sequence of SEQ ID NO: 579.

In one example, a BCMA binding trispecific protein comprises an amino acid sequence of SEQ ID NO: 580. In one example, a BCMA binding trispecific protein comprises an amino acid sequence of SEQ ID NO: 581. In one example, a BCMA binding trispecific protein comprises an amino acid sequence of SEQ ID NO: 582. In one example, a BCMA binding trispecific protein comprises an amino acid sequence of SEQ ID NO: 583. In one example, a BCMA binding trispecific protein comprises an amino acid sequence of SEQ ID NO: 584. In one example, a BCMA binding trispecific protein comprises an amino acid sequence of SEQ ID NO: 585. In one example, a BCMA binding trispecific protein comprises an amino acid sequence of SEQ ID NO: 586. In one example, a BCMA binding trispecific protein comprises an amino acid sequence of SEQ ID NO: 587. In one example, a BCMA binding trispecific protein comprises an amino acid sequence of SEQ ID NO: 588. In one example, a BCMA binding trispecific protein comprises an amino acid sequence of SEQ ID NO: 589.

In one example, a BCMA binding trispecific protein comprises an amino acid sequence of SEQ ID NO: 590. In one example, a BCMA binding trispecific protein comprises an amino acid sequence of SEQ ID NO: 591. In one example, a BCMA binding trispecific protein comprises an amino acid sequence of SEQ ID NO: 592. In one example, a BCMA binding trispecific protein comprises an amino acid sequence of SEQ ID NO: 593. In one example, a BCMA binding trispecific protein comprises an amino acid sequence of SEQ ID NO: 594. In one example, a BCMA binding trispecific protein comprises an amino acid sequence of SEQ ID NO: 595. In one example, a BCMA binding trispecific protein comprises an amino acid sequence of SEQ ID NO: 596. In one example, a BCMA binding trispecific protein comprises an amino acid sequence of SEQ ID NO: 597.

Polynucleotides Encoding BCMA Targeting Trispecific Proteins

Also provided, in some embodiments, are polynucleotide molecules encoding an anti-BCMA trispecific binding protein described herein. In some embodiments, the polynucleotide molecules are provided as a DNA construct. In other embodiments, the polynucleotide molecules are provided as a messenger RNA transcript.

The polynucleotide molecules are constructed by known methods such as by combining the genes encoding the three binding domains either separated by peptide linkers or, in other embodiments, directly linked by a peptide bond, into a single genetic construct operably linked to a suitable promoter, and optionally a suitable transcription terminator, and expressing it in bacteria or other appropriate expression system such as, for example CHO cells. In the embodiments where the BCMA binding domain is a small molecule, the polynucleotides contain genes encoding the CD3 binding domain and the half-life extension domain. In the embodiments where the half-life extension domain is a small molecule, the polynucleotides contain genes encoding the domains that bind to CD3 and BCMA. Depending on the vector system and host utilized, any number of suitable transcription and translation elements, including constitutive and inducible promoters, may be used. The promoter is selected such that it drives the expression of the polynucleotide in the respective host cell.

In some embodiments, the polynucleotide is inserted into a vector, preferably an expression vector, which represents a further embodiment. This recombinant vector can be constructed according to known methods. Vectors of particular interest include plasmids, phagemids, phage derivatives, virii (e.g., retroviruses, adenoviruses, adeno-associated viruses, herpes viruses, lentiviruses, and the like), and cosmids.

A variety of expression vector/host systems may be utilized to contain and express the polynucleotide encoding the polypeptide of the described trispecific antigen-binding protein. Examples of expression vectors for expression in *E. coli* are pSKK (Le Gall et al., *J Immunol Methods.* (2004) 285(1):111-27) or pcDNA5 (Invitrogen) for expression in mammalian cells.

Thus, the BCMA targeting trispecific proteins as described herein, in some embodiments, are produced by introducing a vector encoding the protein as described above into a host cell and culturing said host cell under conditions whereby the protein domains are expressed, may be isolated and, optionally, further purified.

Integration into Chimeric Antigen Receptors (CAR)

The BCMA targeting trispecific antigen binding proteins of the present disclosure can, in certain examples, be incorporated into a chimeric antigen receptor (CAR). An engineered immune effector cell, e.g., a T cell or NK cell, can be used to express a CAR that includes an anti-BCMA targeting trispecific protein containing an anti-BCMA single domain antibody as described herein. In one embodiment, the CAR including an anti-BCMA targeting trispecific protein as described herein is connected to a transmembrane domain via a hinge region, and further a costimulatory domain, e.g., a functional signaling domain obtained from OX40, CD27, CD28, CD5, ICAM-1, LFA-1 (CD11a/CD18), ICOS (CD278), or 4-1BB. In some embodiments, the CAR further comprises a sequence encoding a intracellular signaling domain, such as 4-1BB and/or CD3 zeta.

BCMA Trispecific Protein Modifications

The BCMA targeting trispecific proteins described herein encompass derivatives or analogs in which (i) an amino acid is substituted with an amino acid residue that is not one encoded by the genetic code, (ii) the mature polypeptide is fused with another compound such as polyethylene glycol, or (iii) additional amino acids are fused to the protein, such as a leader or secretory sequence or a sequence for purification of the protein.

Typical modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphatidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Modifications are made anywhere in BCMA targeting trispecific proteins described herein, including the peptide backbone, the amino acid side-chains, and the amino or carboxyl termini. Certain common peptide modifications that are useful for modification of BCMA targeting trispecific proteins include glycosylation, lipid attachment, sulfation, gamma-carboxylation of glutamic acid residues, hydroxylation, blockage of the amino or carboxyl group in a polypeptide, or both, by a covalent modification, and ADP-ribosylation.

Pharmaceutical Compositions

Also provided, in some embodiments, are pharmaceutical compositions comprising an anti-BCMA trispecific binding protein described herein, a vector comprising the polynucleotide encoding the polypeptide of the BCMA targeting trispecific proteins or a host cell transformed by this vector and at least one pharmaceutically acceptable carrier. The term "pharmaceutically acceptable carrier" includes, but is not limited to, any carrier that does not interfere with the effectiveness of the biological activity of the ingredients and that is not toxic to the patient to whom it is administered. Examples of suitable pharmaceutical carriers are well known in the art and include phosphate buffered saline solutions, water, emulsions, such as oil/water emulsions, various types of wetting agents, sterile solutions etc. Such carriers can be formulated by conventional methods and can be administered to the subject at a suitable dose. Preferably, the compositions are sterile. These compositions may also contain adjuvants such as preservative, emulsifying agents and dispersing agents. Prevention of the action of microorganisms may be ensured by the inclusion of various antibacterial and antifungal agents. A further embodiment provides one or more of the above described BCMA targeting trispecific proteins packaged in lyophilized form, or packaged in an aqueous medium.

In some embodiments of the pharmaceutical compositions, the BCMA targeting trispecific proteins described herein are encapsulated in nanoparticles. In some embodiments, the nanoparticles are fullerenes, liquid crystals, liposome, quantum dots, superparamagnetic nanoparticles, dendrimers, or nanorods. In other embodiments of the pharmaceutical compositions, the BCMA trispecific antigen-binding protein is attached to liposomes. In some instances, the BCMA trispecific antigen-binding proteins are conjugated to the surface of liposomes. In some instances, the BCMA trispecific antigen-binding proteins are encapsulated within the shell of a liposome. In some instances, the liposome is a cationic liposome.

The BCMA targeting trispecific proteins described herein are contemplated for use as a medicament. Administration is effected by different ways, e.g. by intravenous, intraperitoneal, subcutaneous, intramuscular, topical or intradermal administration. In some embodiments, the route of administration depends on the kind of therapy and the kind of compound contained in the pharmaceutical composition. The dosage regimen will be determined by the attending physician and other clinical factors. Dosages for any one patient depends on many factors, including the patient's size, body surface area, age, sex, the particular compound to be administered, time and route of administration, the kind of therapy, general health and other drugs being administered concurrently. An "effective dose" refers to amounts of the active ingredient that are sufficient to affect the course and the severity of the disease, leading to the reduction or remission of such pathology and may be determined using known methods.

In some embodiments, the BCMA targeting trispecific proteins of this disclosure are administered at a dosage of up to 10 mg/kg at a frequency of once a week. In some cases, the dosage ranges from about 1 ng/kg to about 10 mg/kg. In some embodiments, the dose is from about 1 ng/kg to about 10 ng/kg, about 5 ng/kg to about 15 ng/kg, about 12 ng/kg to about 20 ng/kg, about 18 ng/kg to about 30 ng/kg, about 25 ng/kg to about 50 ng/kg, about 35 ng/kg to about 60 ng/kg, about 45 ng/kg to about 70 ng/kg, about 65 ng/kg to about 85 ng/kg, about 80 ng/kg to about 1 µg/kg, about 0.5 µg/kg to about 5 µg/kg, about 2 µg/kg to about 10 µg/kg, about 7 µg/kg to about 15 µg/kg, about 12 µg/kg to about 25 µg/kg, about 20 µg/kg to about 50 µg/kg, about 35 µg/kg to about 70 µg/kg, about 45 µg/kg to about 80 µg/kg, about 65 µg/kg to about 90 µg/kg, about 85 µg/kg to about 0.1 mg/kg, about 0.095 mg/kg to about 10 mg/kg. In some cases, the dosage is about 0.1 mg/kg to about 0.2 mg/kg; about 0.25 mg/kg to about 0.5 mg/kg, about 0.45 mg/kg to about 1 mg/kg, about 0.75 mg/kg to about 3 mg/kg, about 2.5 mg/kg to about 4 mg/kg, about 3.5 mg/kg to about 5 mg/kg, about 4.5 mg/kg to about 6 mg/kg, about 5.5 mg/kg to about 7 mg/kg, about 6.5 mg/kg to about 8 mg/kg, about 7.5 mg/kg to about 9 mg/kg, or about 8.5 mg/kg to about 10 mg/kg. The frequency of administration, in some embodiments, is about less than daily, every other day, less than once a day, twice a week, weekly, once in 7 days, once in two weeks, once in two weeks, once in three weeks, once in four weeks, or once a month. In some cases, the frequency of administration is weekly. In some cases, the frequency of administration is weekly and the dosage is up to 10 mg/kg. In some cases, duration of administration is from about 1 day to about 4 weeks or longer.

Methods of Treatment

In certain embodiments, the BCMA targeting trispecific proteins of the disclosure reduce the growth of tumor cells in vivo when administered to a subject who has tumor cells that express BCMA. Measurement of the reduction of the growth of tumor cells can be determined by multiple different methodologies well known in the art. Non-limiting examples include direct measurement of tumor dimension, measurement of excised tumor mass and comparison to control subjects, measurement via imaging techniques (e.g., CT or MRI) that may or may not use isotopes or luminescent molecules (e.g., luciferase) for enhanced analysis, and the like. In specific embodiments, administration of the trispecific proteins of the disclosure results in a reduction of in vivo growth of tumor cells as compared to a control antigen binding agent by at least about 10%, 20%, 30%, 40%, 50%, 60%, 70%, 80%, 90% or 100%, with an about 100% reduction in tumor growth indicating a complete response and disappearance of the tumor. In further embodiments, administration of the trispecific proteins of the disclosure results in a reduction of in vivo growth of tumor cells as compared to a control antigen binding agent by about 50-100%, about 75-100% or about 90-100%. In further embodiments, administration of the trispecific proteins of the disclosure results in a reduction of in vivo growth of tumor cells as compared to a control antigen binding agent by about 50-60%, about 60-70%, about 70-80%, about 80-90%, or about 90-100%.

Also provided herein, in some embodiments, are methods and uses for stimulating the immune system of an individual in need thereof comprising administration of an anti-BCMA targeting trispecific protein as described herein. In some instances, the administration of an anti-BCMA targeting trispecific protein described herein induces and/or sustains cytotoxicity towards a cell expressing a target antigen.

Also provided herein, in some embodiments, are methods and uses for stimulating the immune system of an individual in need thereof comprising administration of a BCMA binding protein as described herein. In some instances, the administration of a BCMA binding protein described herein induces and/or sustains cytotoxicity towards a cell expressing a target antigen. In some instances, the cell expressing a target antigen is a terminally differentiated B cell that is a cancer or tumor cell, or a metastatic cancer or tumor cell.

Also provided herein are methods and uses for a treatment of a disease, disorder or condition associated with BCMA comprising administering to an individual in need thereof a BCMA binding protein or a multispecific binding protein comprising the BCMA binding protein described herein.

Diseases, disorders or conditions associated with BCMA include, but are not limited to, a cancer or a metastasis that is of a B cell lineage.

Cancers that can be treated, prevented, or managed by the BCMA binding proteins of the present disclosure, and methods of using them, include but are not limited to a primary cancer or a metastatic cancer.

Examples of such leukemias include, but are not limited to: acute lymphoblastic leukemia (ALL), acute myeloid leukemia (AML), chronic lymphocytic leukemia (CLL) and chronic myeloid leukemia (CML), as well as a number of less common types such as, for example, Hairy cell leukemia (HCL), T-cell prolymphocytic leukemia (T-PLL), Large granular lymphocytic leukemia and Adult T-cell leukemia, etc. Acute lymphoblastic leukemia (ALL) subtypes to be treated include, but are not limited to, precursor B acute lymphoblastic leukemia, precursor T acute lymphoblastic leukemia, Burkitt's leukemia, and acute biphenotypic leukemia. Chronic lymphocytic leukemia (CLL) subtypes to be treated include, but are not limited to, B-cell prolymphocytic leukemia. Acute myelogenous leukemia (AML) subtypes to be treated include, but are not limited to, acute promyelocytic leukemia, acute myeloblastic leukemia, and acute megakaryoblastic leukemia. Chronic myelogenous leukemia (CML) subtypes to be treated include, but are not limited to, chronic myelomonocytic leukemia.

Examples of a lymphoma to be treated with the subject methods include, but not limited to Hodgkin's disease, non-Hodgkin's disease, or any subtype of lymphoma.

Examples of such multiple myelomas include, but are not limited to, a multiple myeloma of the bone or other tissues including, for example, a smoldering multiple myeloma, a non-secretory myeloma, a osteosclerotic myeloma, etc.

For a review of such disorders, see Fishman et al., 1985, Medicine, 2d Ed., J.B. Lippincott Co., Philadelphia and Murphy et al., 1997, Informed Decisions: The Complete Book of Cancer Diagnosis, Treatment, and Recovery, Viking Penguin, Penguin Books U.S.A., Inc., United States of America).

As used herein, in some embodiments, "treatment" or "treating" or "treated" refers to therapeutic treatment wherein the object is to slow (lessen) an undesired physiological condition, disorder or disease, or to obtain beneficial or desired clinical results. For the purposes described herein, beneficial or desired clinical results include, but are not limited to, alleviation of symptoms; diminishment of the extent of the condition, disorder or disease; stabilization (i.e., not worsening) of the state of the condition, disorder or disease; delay in onset or slowing of the progression of the condition, disorder or disease; amelioration of the condition, disorder or disease state; and remission (whether partial or total), whether detectable or undetectable, or enhancement or improvement of the condition, disorder or disease. Treatment includes eliciting a clinically significant response without excessive levels of side effects. Treatment also includes prolonging survival as compared to expected survival if not receiving treatment. In other embodiments, "treatment" or "treating" or "treated" refers to prophylactic measures, wherein the object is to delay onset of or reduce severity of an undesired physiological condition, disorder or disease, such as, for example is a person who is predisposed to a disease (e.g., an individual who carries a genetic marker for a disease such as breast cancer).

In some embodiments of the methods described herein, the BCMA targeting trispecific proteins as described herein are administered in combination with an agent for treatment of the particular disease, disorder or condition. Agents include, but are not limited to, therapies involving antibodies, small molecules (e.g., chemotherapeutics), hormones (steroidal, peptide, and the like), radiotherapies (γ-rays, X-rays, and/or the directed delivery of radioisotopes, microwaves, UV radiation and the like), gene therapies (e.g., antisense, retroviral therapy and the like) and other immunotherapies. In some embodiments, an anti-BCMA targeting trispecific protein as described herein is administered in combination with anti-diarrheal agents, anti-emetic agents, analgesics, opioids and/or non-steroidal anti-inflammatory agents. In some embodiments, an anti-BCMA targeting trispecific protein as described herein is administered in combination with anti-cancer agents.

Non-limiting examples of anti-cancer agents that can be used in the various embodiments of the disclosure, including pharmaceutical compositions and dosage forms and kits of the disclosure, include: acivicin; aclarubicin; acodazole hydrochloride; acronine; adozelesin; aldesleukin; altretamine; ambomycin; ametantrone acetate; aminoglutethimide; amsacrine; anastrozole; anthramycin; asparaginase; asperlin; azacitidine; azetepa; azotomycin; batimastat; benzodepa; bicalutamide; bisantrene hydrochloride; bisnafide dimesylate; bizelesin; bleomycin sulfate; brequinar sodium; bropirimine; busulfan; cactinomycin; calusterone; caracemide; carbetimer; carboplatin; carmustine; carubicin hydrochloride; carzelesin; cedefingol; chlorambucil; cirolemycin; cisplatin; cladribine; crisnatol mesylate; cyclophosphamide; cytarabine; dacarbazine; dactinomycin; daunorubicin hydrochloride; decitabine; dexormaplatin; dezaguanine; dezaguanine mesylate; diaziquone; docetaxel; doxorubicin; doxorubicin hydrochloride; droloxifene; droloxifene citrate; dromostanolone propionate; duazomycin; edatrexate; eflornithine hydrochloride; elsamitrucin; enloplatin; enpromate; epipropidine; epirubicin hydrochloride; erbulozole; esorubicin hydrochloride; estramustine; estramustine phosphate sodium; etanidazole; etoposide; etoposide phosphate; etoprine; fadrozole hydrochloride; fazarabine; fenretinide; floxuridine; fludarabine phosphate; fluorouracil; flurocitabine; fosquidone; fostriecin sodium; gemcitabine; gemcitabine hydrochloride; hydroxyurea; idarubicin hydrochloride; ifosfamide; ilmofosine; interleukin II (including recombinant interleukin II, or rIL2), interferon alpha-2a; interferon alpha-2b; interferon alpha-n1 interferon alpha-n3; interferon beta-I a; interferon gamma-I b; iproplatin; irinotecan hydrochloride; lanreotide acetate; letrozole; leuprolide acetate; liarozole hydrochloride; lometrexol sodium; lomustine; losoxantrone hydrochloride; masoprocol; maytansine; mechlorethamine hydrochloride; megestrol acetate; melengestrol acetate; melphalan; menogaril; mercaptopurine; methotrexate; methotrexate sodium; metoprine; meturedepa; mitindomide; mitocarcin; mitocromin; mitogillin; mitomalcin; mitomycin; mitosper; mitotane; mitoxantrone hydrochloride; mycophenolic acid; nocodazole; nogalamycin; ormaplatin; oxisuran; paclitaxel; pegaspargase; peliomycin; pentamustine; peplomycin sulfate; perfosfamide; pipobroman; piposulfan; piroxantrone hydrochloride; plicamycin; plomestane; porfimer sodium; porfiromycin; prednimustine; procarbazine hydrochloride; puromycin; puromycin hydrochloride; pyrazofurin; riboprine; rogletimide; safingol; safingol hydrochloride; semustine; simtrazene; sparfosate sodium; sparsomycin; spirogermanium hydrochloride; spiromustine; spiroplatin; streptonigrin; streptozocin; sulofenur; talisomycin; tecogalan sodium; tegafur; teloxantrone hydrochloride; temoporfin; teniposide; teroxirone; testolactone; thiamiprine; thioguanine; thiotepa; tiazofurin; tirapazamine; toremifene citrate; trestolone acetate; triciribine phosphate; trimetrexate; trimetrexate glucuronate; triptorelin; tubulozole hydrochloride; uracil mustard; uredepa; vapreotide; verteporfin; vinblastine sulfate; vincristine sulfate; vindesine; vindesine sulfate; vinepidine sulfate; vinglycinate sulfate; vinleurosine sulfate; vinorelbine tartrate; vinzolidine sulfate; vinzolidine sulfate; vorozole; zeniplatin; zinostatin; zorubicin hydrochloride. Other examples of anti-cancer drugs include, but are not limited to: 20-epi-1,25 dihydroxyvitamin D3; 5-ethynyluracil; abiraterone; aclarubicin; acylfulvene; adecypenol; adozelesin; aldesleukin; ALL-TK antagonists; altretamine; ambamustine; amidox; amifostine; aminolevulinic acid; amrubicin; amsacrine; anagrelide; anastrozole; andrographolide; angiogenesis inhibitors; antagonist D; antagonist G; antarelix; anti-dorsalizing morphogenetic protein-1; antiandrogen, prostatic carcinoma; antiestrogen; antineoplaston; antisense oligonucleotides; aphidicolin glycinate; apoptosis gene modulators; apoptosis regulators; apurinic acid; ara-CDP-DL-PTBA; arginine deaminase; asulacrine; atamestane; atrimustine; axinastatin 1; axinastatin 2; axinastatin 3; azasetron; azatoxin; azatyrosine; baccatin III derivatives; balanol; batimastat; BCR/ABL antagonists; benzochlorins; benzoylstaurosporine; beta lactam derivatives; beta-alethine; betaclamycin B; betulinic acid; bFGF inhibitor; bicalutamide; bisantrene; bisaziridinylspermine; bisnafide; bistratene A; bizelesin; breflate; bropirimine; budotitane; buthionine sulfoximine; calcipotriol; calphostin C; camptothecin derivatives; canarypox IL-2; capecitabine; carboxamide-amino-triazole; carboxyamidotriazole; CaRest M3; CARN 700; cartilage derived inhibitor; carzelesin; casein kinase inhibitors (ICOS); castanospermine; cecropin B; cetrorelix; chlorins; chloroquinoxaline sulfonamide; cicaprost; cis-porphyrin; cladribine; clomifene analogues; clotrimazole; collismycin A; collismycin B; combretastatin A4; combretastatin analogue; conagenin; crambescidin 816; crisnatol; cryptophycin 8; cryptophycin A derivatives; curacin A; cyclopentanthraquinones; cycloplatam; cypemycin; cytarabine ocfosfate; cytolytic factor; cytostatin; dacliximab; decitabine; dehydrodidemnin B; deslorelin; dexamethasone; dexifosfamide; dexrazoxane; dexverapamil; diaziquone; didemnin B; didox; diethylnorspermine; dihydro-5-azacytidine; dihydrotaxol, 9-; dioxamycin; diphenyl spiromustine; docetaxel; docosanol; dolasetron; doxifluridine; droloxifene; dronabinol; duocarmycin SA; ebselen; ecomustine; edelfosine; edrecolomab; eflornithine; elemene; emitefur; epirubicin; episteride; estramustine analogue; estrogen agonists; estrogen antagonists; etanidazole; etoposide phosphate; exemestane; fadrozole; fazarabine; fenretinide; filgrastim; finasteride; flavopiridol; flezelastine; fluasterone; fludarabine; fluorodaunorunicin hydrochloride; forfenimex; formestane; fostriecin; fotemustine; gadolinium texaphyrin; gallium nitrate; galocitabine; ganirelix; gelatinase inhibitors; gemcitabine; glutathione inhibitors; hepsulfam; heregulin; hexamethylene bisacetamide; hypericin; ibandronic acid; idarubicin; idoxifene; idramantone; ilmofosine; ilomastat; imidazoacridones; imiquimod; immunostimulant peptides; insulin-like growth factor-I receptor inhibitor; interferon agonists; interferons; interleukins; iobenguane; iododoxorubicin; ipomeanol, 4-; iroplact; irsogladine; isobengazole; isohomohalicondrin B; itasetron; jasplakinolide; kahalalide F; lamellarin-N triacetate; lanreotide; leinamycin; lenograstim; lentinan sulfate; leptolstatin; letrozole; leukemia inhibiting factor; leukocyte alpha interferon; leuprolide+estrogen+progesterone; leuprorelin; levamisole; liarozole; linear polyamine analogue; lipophilic disaccharide peptide; lipophilic platinum compounds; lissoclinamide 7; lobaplatin; lombricine; lometrexol; lonidamine; losoxantrone; HMG-CoA reductase inhibitor (such as but not limited to, Lovastatin, Pravastatin, Fluvastatin, Statin, Simvastatin, and Atorvastatin); loxoribine; lurtotecan; lutetium texaphyrin; lysofylline; lytic peptides; maitansine; mannostatin A; marimastat; masoprocol; maspin; matrilysin inhibitors; matrix metalloproteinase inhibitors; menogaril; merbarone; meterelin; methioninase; metoclopramide; MIF inhibitor; mifepristone; miltefosine; mirimostim; mismatched double stranded RNA; mitoguazone; mitolactol; mitomycin analogues; mitonafide; mitotoxin fibroblast growth factor-saporin; mitoxantrone; mofarotene; molgramostim; monoclonal antibody, human chorionic gonadotrophin; monophosphoryl lipid A+myobacterium cell wall sk; mopidamol; multiple drug resistance gene inhibitor; multiple tumor suppressor 1-based therapy; mustard anticancer agent; mycaperoxide B; mycobacterial cell wall extract; myriaporone; N-acetyldinaline; N-substituted benzamides; nafarelin; nagrestip; naloxone+pentazocine; napavin; naphterpin; nartograstim; nedaplatin; nemorubicin; neridronic acid; neutral endopeptidase; nilutamide; nisamycin; nitric oxide modulators; nitroxide antioxidant; nitrullyn; O6-benzylguanine; octreotide; okicenone; oligonucleotides; onapristone; ondansetron; ondansetron; oracin; oral cytokine inducer; ormaplatin; osaterone; oxaliplatin; oxaunomycin; paclitaxel; paclitaxel analogues; paclitaxel derivatives; palauamine; palmitoylrhizoxin; pamidronic acid; panaxytriol; panomifene; parabactin; pazelliptine; pegaspargase; peldesine; pentosan polysulfate sodium; pentostatin; pentrozole; perflubron; perfosfamide; perillyl alcohol; phenazinomycin; phenylacetate; phosphatase inhibitors; picibanil; pilocarpine hydrochloride; pirarubicin; piritrexim; placetin A; placetin B; plasminogen activator inhibitor; platinum complex; platinum compounds; platinum-triamine complex; porfimer sodium; porfiromycin; prednisone; propyl bis-acridone; prostaglandin J2; proteasome inhibitors; protein A-based immune modulator; protein kinase C inhibitor; protein kinase C inhibitors, microalgal; protein tyrosine phosphatase inhibitors; purine nucleoside phosphorylase inhibitors; purpurins; pyrazoloacridine; pyridoxylated hemoglobin polyoxyethylene conjugate; raf antagonists; raltitrexed; ramosetron; ras farnesyl protein transferase inhibitors; ras inhibitors; ras-GAP inhibitor; retelliptine demethylated; rhenium Re 186 etidronate; rhizoxin; ribozymes; RII retinamide; rogletimide; rohitukine; romurtide; roquinimex; rubiginone B1; ruboxyl; safingol; saintopin; SarCNU; sarcophytol A; sargramostim; Sdi 1 mimetics; semustine; senescence derived inhibitor 1; sense oligonucleotides; signal transduction inhibitors; signal transduction modulators; single chain antigen binding protein; sizofiran; sobuzoxane; sodium borocaptate; sodium phenylacetate; solverol; somatomedin binding protein; sonermin; sparfosic acid; spicamycin D; spiromustine; splenopentin; spongistatin 1; squalamine; stem cell inhibitor; stem-cell division inhibitors; stipiamide; stromelysin inhibitors; sulfinosine; superactive vasoactive intestinal peptide antagonist; suradista; suramin; swainsonine; synthetic glycosaminoglycans; tallimustine; tamoxifen methiodide; tauromustine; tazarotene; tecogalan sodium; tegafur; tellurapyrylium; telomerase inhibitors; temoporfin; temozolomide; teniposide; tetrachlorodecaoxide; tetrazomine; thaliblastine; thiocoraline; thrombopoietin; thrombopoietin mimetic; thymalfasin; thymopoietin receptor agonist; thymotrinan; thyroid stimulating hormone; tin ethyl etiopurpurin; tirapazamine; titanocene bichloride; topsentin; toremifene; totipotent stem cell factor; translation inhibitors; tretinoin; triacetyluridine; triciribine; trimetrexate; triptorelin; tropisetron; turosteride; tyrosine kinase inhibitors; tyrphostins; UBC inhibitors; ubenimex; urogenital sinus-derived growth inhibitory factor; urokinase receptor antagonists; vapreotide; variolin B; vector system, erythrocyte gene therapy; velaresol; veramine; verdins; verteporfin; vinorelbine; vinxaltine; VITAXIN®; vorozole; zanoterone; zeniplatin; zilascorb; and zinostatin stimalamer. Additional anti-cancer drugs are 5-fluorouracil and leucovorin. These two agents are particularly useful when used in methods employing thalidomide and a topoisomerase inhibitor. In some embodiments, the anti-BCMA targeting trispecific protein of the present disclosure is used in combination with gemcitabine.

In some embodiments, the anti-BCMA targeting trispecific protein as described herein is administered before, during, or after surgery.

In some embodiments, the anti-cancer agent is conjugated via any suitable means to the trispecific protein.

Methods of Detection of BCMA Expression and Diagnosis of BCMA Associated Cancer

According to another embodiment of the disclosure, kits for detecting expression of BCMA in vitro and/or in vivo are provided. The kits include the foregoing BCMA targeting trispecific proteins (e.g., a trispecific protein containing a labeled anti-BCMA single domain antibody or antigen binding fragments thereof), and one or more compounds for detecting the label. In some embodiments, the label is selected from the group consisting of a fluorescent label, an enzyme label, a radioactive label, a nuclear magnetic resonance active label, a luminescent label, and a chromophore label.

In some cases, BCMA expression is detected in a biological sample. The sample can be any sample, including, but not limited to, tissue from biopsies, autopsies and pathology specimens. Biological samples also include sections of tissues, for example, frozen sections taken for histological purposes. Biological samples further include body fluids, such as blood, serum, plasma, sputum, spinal fluid or urine. A biological sample is typically obtained from a mammal, such as a human or non-human primate.

Samples to be obtained for use in an assay described herein include tissues and bodily fluids may be processed using conventional means in the art (e.g., homogenization, serum isolation, etc.). Accordingly, a sample obtained from a patient is transformed prior to use in an assay described herein. BCMA, if present in the sample, is further transformed in the methods described herein by virtue of binding to, for example, an antibody.

In one embodiment, provided is a method of determining if a subject has cancer by contacting a sample from the subject with an anti-BCMA single domain antibody as disclosed herein; and detecting binding of the single domain antibody to the sample. An increase in binding of the antibody to the sample as compared to binding of the antibody to a control sample identifies the subject as having cancer.

In another embodiment, provided is a method of confirming a diagnosis of cancer in a subject by contacting a sample from a subject diagnosed with cancer with an anti-BCMA single domain antibody as disclosed herein; and detecting binding of the antibody to the sample. An increase in binding of the antibody to the sample as compared to binding of the antibody to a control sample confirms the diagnosis of cancer in the subject.

In some examples of the disclosed methods, the BCMA single domain antibody of the trispecific protein is directly labeled.

In some examples, the methods further include contacting a second antibody that specifically binds the anti-BCMA single domain antibody with the sample; and detecting the binding of the second antibody. An increase in binding of the second antibody to the sample as compared to binding of the second antibody to a control sample detects cancer in the subject or confirms the diagnosis of cancer in the subject.

In some cases, the cancer is a leukemia, a lymphoma, a multiple myeloma, or any other type of cancer that expresses BCMA.

In some examples, the control sample is a sample from a subject without cancer. In particular examples, the sample is a blood or tissue sample.

In some cases, the antibody that binds (for example specifically binds) BCMA is directly labeled with a detectable label. In another embodiment, the antibody that binds (for example, specifically binds) BCMA (the first antibody) is unlabeled and a second antibody or other molecule that can bind the antibody that specifically binds BCMA is labeled. A second antibody is chosen such that it is able to specifically bind the specific species and class of the first antibody. For example, if the first antibody is a llama IgG, then the secondary antibody may be an anti-llama-IgG. Other molecules that can bind to antibodies include, without limitation, Protein A and Protein G, both of which are available commercially. Suitable labels for the antibody or secondary antibody are described above, and include various enzymes, prosthetic groups, fluorescent materials, luminescent materials, magnetic agents and radioactive materials. Non-limiting examples of suitable enzymes include horseradish peroxidase, alkaline phosphatase, beta-galactosidase, or acetylcholinesterase. Non-limiting examples of suitable prosthetic group complexes include streptavidin/biotin and avidin/biotin. Non-limiting examples of suitable fluorescent materials include umbelliferone, fluorescein, fluorescein isothiocyanate, rhodamine, dichlorotriazinylamine fluorescein, dansyl chloride or phycoerythrin. A non-limiting exemplary luminescent material is luminol; a non-limiting exemplary a magnetic agent is gadolinium, and non-limiting exemplary radioactive labels include 125I, 131I, 35S or 3H.

In an alternative embodiment, BCMA can be assayed in a biological sample by a competition immunoassay utilizing BCMA standards labeled with a detectable substance and an unlabeled antibody that specifically binds BCMA. In this assay, the biological sample, the labeled BCMA standards and the antibody that specifically bind BCMA are combined and the amount of labeled BCMA standard bound to the unlabeled antibody is determined. The amount of BCMA in the biological sample is inversely proportional to the amount of labeled BCMA standard bound to the antibody that specifically binds BCMA.

The immunoassays and method disclosed herein can be used for a number of purposes. In one embodiment, the antibody that specifically binds BCMA may be used to detect the production of BCMA in cells in cell culture. In another embodiment, the antibody can be used to detect the amount of BCMA in a biological sample, such as a tissue sample, or a blood or serum sample. In some examples, the BCMA is cell-surface BCMA. In other examples, the BCMA is soluble BCMA (e.g., BCMA in a cell culture supernatant or soluble BCMA in a body fluid sample, such as a blood or serum sample).

In one embodiment, a kit is provided for detecting BCMA in a biological sample, such as a blood sample or tissue sample. For example, to confirm a cancer diagnosis in a subject, a biopsy can be performed to obtain a tissue sample for histological examination. Alternatively, a blood sample can be obtained to detect the presence of soluble BCMA protein or fragment. Kits for detecting a polypeptide will typically comprise a single domain antibody, according to the present disclosure, that specifically binds BCMA. In some embodiments, an antibody fragment, such as a scFv fragment, a VH domain, or a Fab is included in the kit. In a further embodiment, the antibody is labeled (for example, with a fluorescent, radioactive, or an enzymatic label).

In one embodiment, a kit includes instructional materials disclosing means of use of an antibody that binds BCMA. The instructional materials may be written, in an electronic form (such as a computer diskette or compact disk) or may be visual (such as video files), or provided through an electronic network, for example, over the internet, World Wide Web, an intranet, or other network. The kits may also include additional components to facilitate the particular application for which the kit is designed. Thus, for example, the kit may additionally contain means of detecting a label (such as enzyme substrates for enzymatic labels, filter sets to detect fluorescent labels, appropriate secondary labels such as a secondary antibody, or the like). The kits may additionally include buffers and other reagents routinely used for the practice of a particular method. Such kits and appropriate contents are well known to those of skill in the art.

In one embodiment, the diagnostic kit comprises an immunoassay. Although the details of the immunoassays may vary with the particular format employed, the method of detecting BCMA in a biological sample generally includes the steps of contacting the biological sample with an antibody which specifically reacts, under immunologically reactive conditions, to a BCMA polypeptide. The antibody is allowed to specifically bind under immunologically reactive conditions to form an immune complex, and the presence of the immune complex (bound antibody) is detected directly or indirectly.

Methods of determining the presence or absence of a cell surface marker are well known in the art. For example, the antibodies can be conjugated to other compounds including, but not limited to, enzymes, magnetic beads, colloidal magnetic beads, haptens, fluorochromes, metal compounds, radioactive compounds or drugs. The antibodies can also be utilized in immunoassays such as but not limited to radio-immunoassays (RIAs), ELISA, or immunohistochemical assays. The antibodies can also be used for fluorescence activated cell sorting (FACS). FACS employs a plurality of color channels, low angle and obtuse light-scattering detection channels, and impedance channels, among other more sophisticated levels of detection, to separate or sort cells (see U.S. Pat. No. 5,061,620). Any of the single domain antibodies that bind BCMA, as disclosed herein, can be used in these assays. Thus, the antibodies can be used in a conventional immunoassay, including, without limitation, an ELISA, an RIA, FACS, tissue immunohistochemistry, Western blot or immunoprecipitation.

EXAMPLES

The application may be better understood by reference to the following non-limiting examples, which are provided as exemplary embodiments of the application. The following examples are presented in order to more fully illustrate embodiments and should in no way be construed, however, as limiting the broad scope of the application.

Example 1

Ability of an Exemplar BCMA Targeting Trispecific Protein to Mediate T Cell Killing of Cancer Cells Expressing BCMA, in TDCC (T Cell Dependent Cell Cytotoxic) Assays Protein Production Sequences of BCMA targeting trispecific molecules, containing a BCMA binding protein according to the present disclosure, were cloned into mammalian expression vector pcDNA 3.4 (Invitrogen) preceded by a leader sequence and followed by a 6× Histidine Tag (SEQ ID NO: 471). EXPI293™ cells (Life Technologies A14527) were maintained in suspension in Optimum Growth Flasks (Thomson) between 0.2 to 8×1e6 cells/mL in EXPI293™ media. Purified plasmid DNA was transfected into EXPI293™ cells in accordance with EXPI293™ Expression System Kit (Life Technologies, A14635) protocols, and maintained for 4-6 days post transfection. The amount of the exemplary trispecific proteins being tested, in the conditioned media, from the transfected EXPI293™ cells was quantitated using an Octet instrument with Protein A tips and using a control trispecific protein for a standard curve.

T Cell Dependent Cellular Cytotoxicity Assays

Titrations of conditioned media was added to TDCC assays (T cell Dependent Cell Cytotoxicity assays) to assess whether the anti-BCMA single domain antibody is capable of forming a synapse between T cells and a BCMA-expressing cell line and direct the T cells to kill the BCMA-expressing cell line. In this assay (Nazarian et al., 2015. *J. Biomol. Screen.*, 20:519-27), T cells and target cancer cell line cells were mixed together at a 10:1 ratio in a 384-well plate, and varying amounts of the trispecific proteins being tested were added. The tumor cell lines were engineered to express luciferase protein. After 48 hours, to quantitate the remaining viable tumor cells, STEADY-GLO® Luminescent Assay (Promega) was used.

Figure 2:
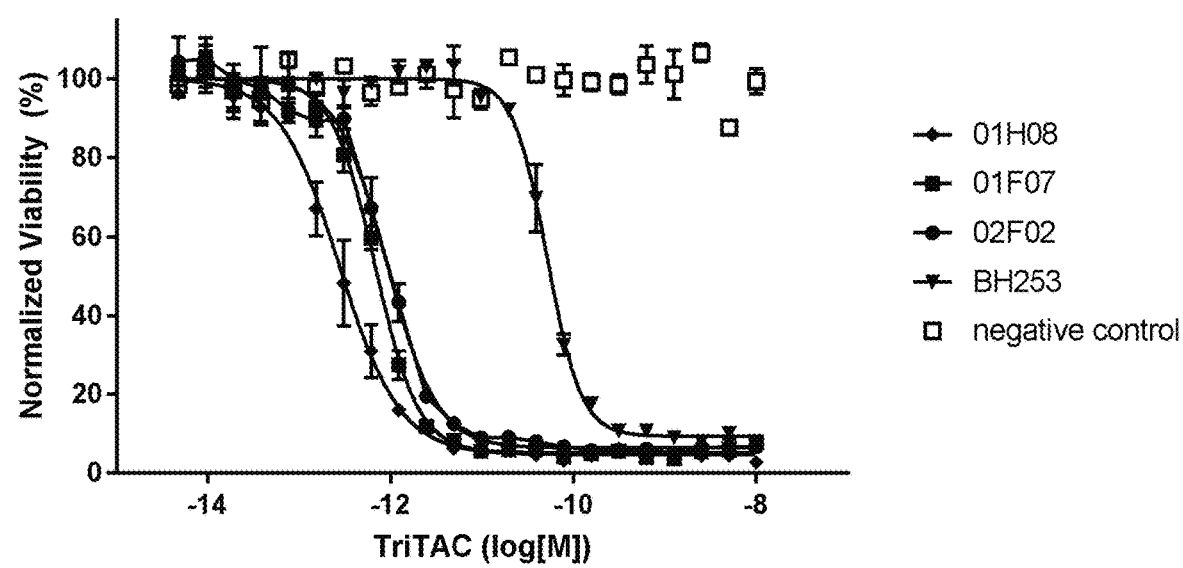
FIG. 2 illustrates the effect of exemplary BCMA targeting molecules (01H08, 01F07, 02F02, and BH253), containing an anti-BCMA binding protein according to the present disclosure, in killing of purified human T cells that expresses BCMA compared to a negative control.
Figure 4A:
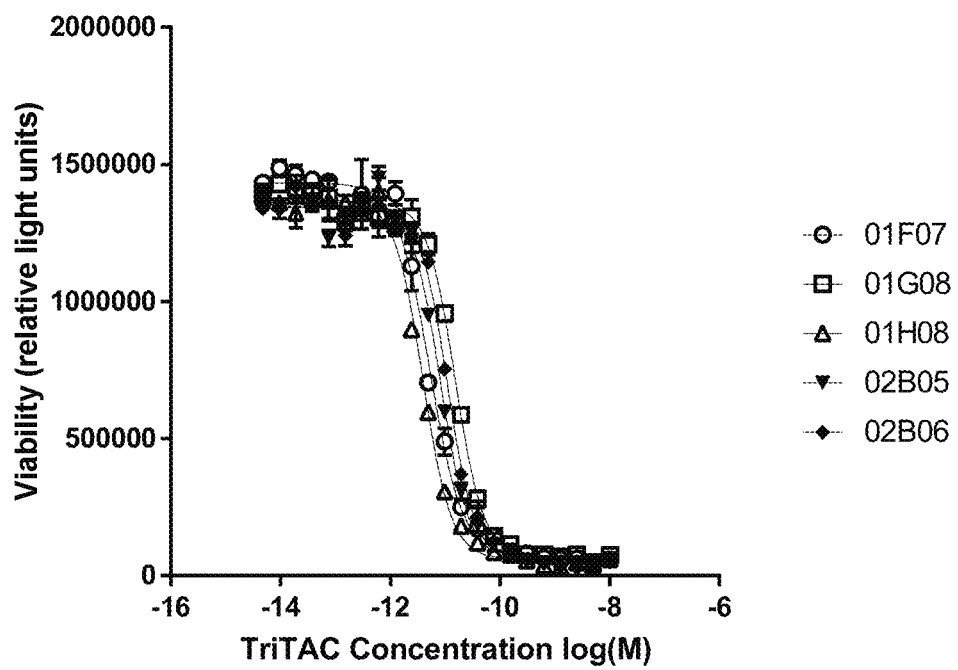
FIGS. 4A-4I illustrate the effect of exemplary BCMA trispecific targeting molecules containing an anti-BCMA binding protein according to the present disclosure in killing of Jeko1, MOLP-8 or OPM-2 cells that express BCMA compared to a negative control.
Figure 4B:
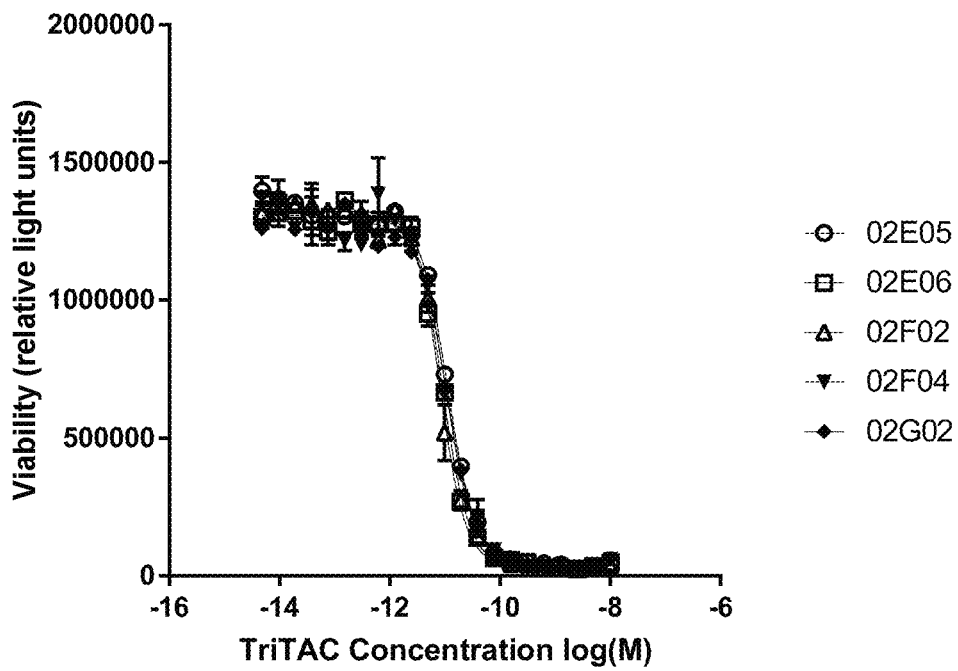
Figure 4C:
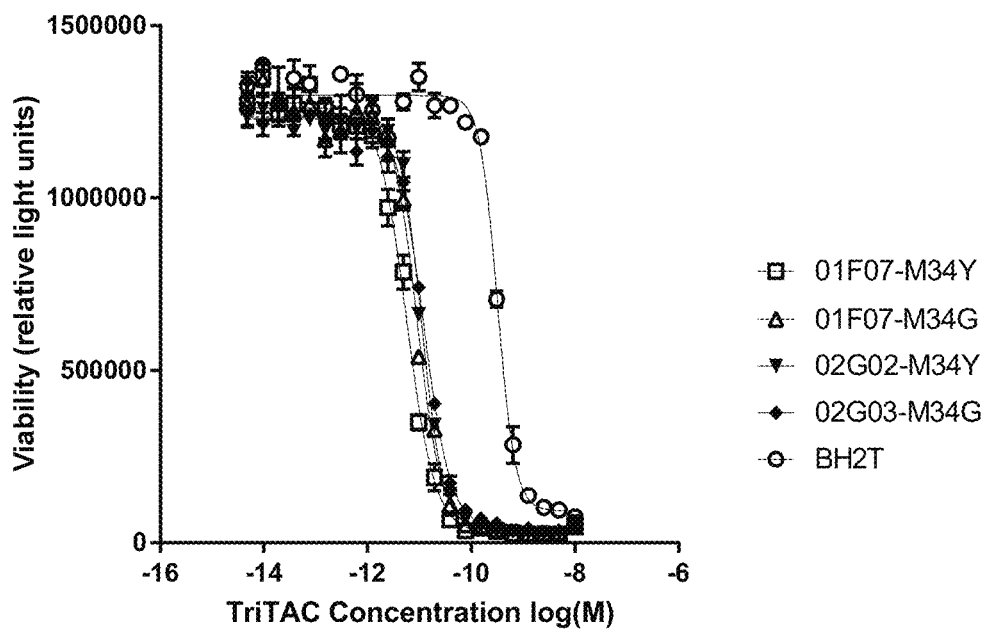
Figure 4D:
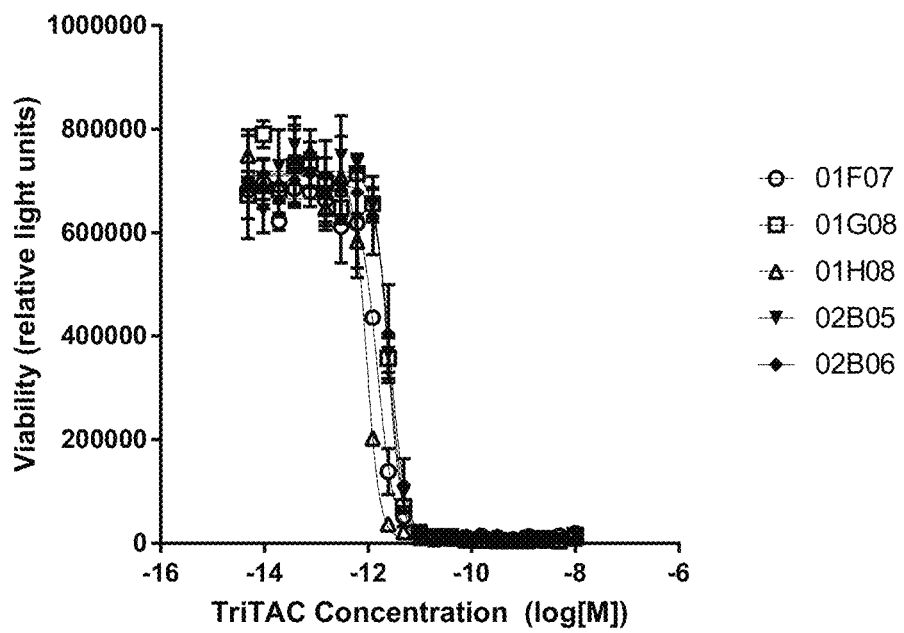
Figure 4E:
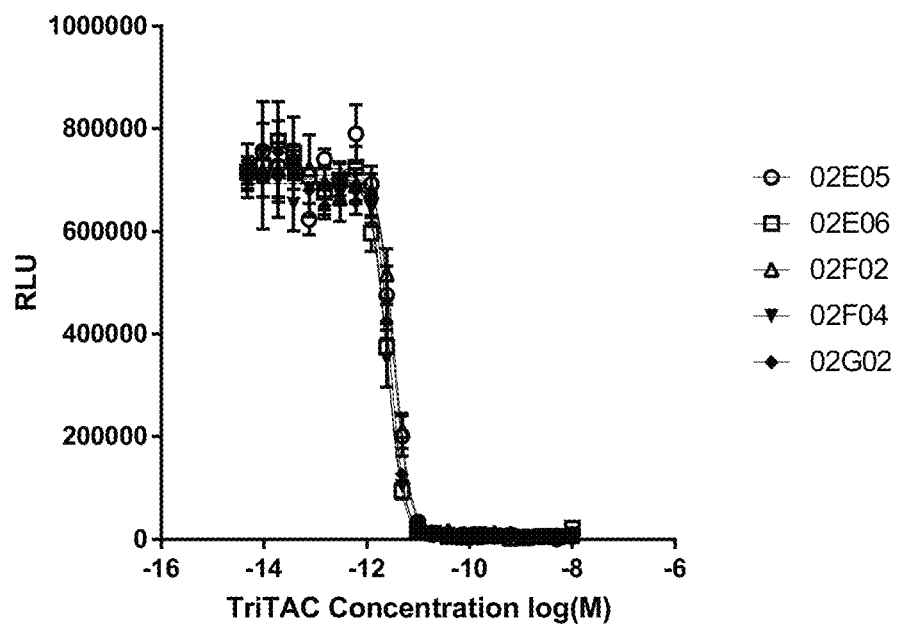
Figure 4F:
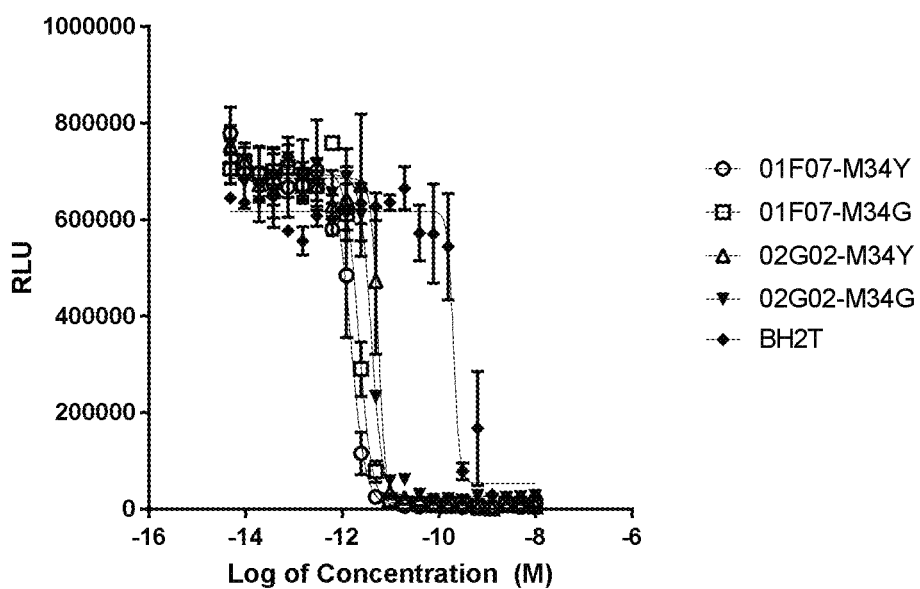
Figure 4G:
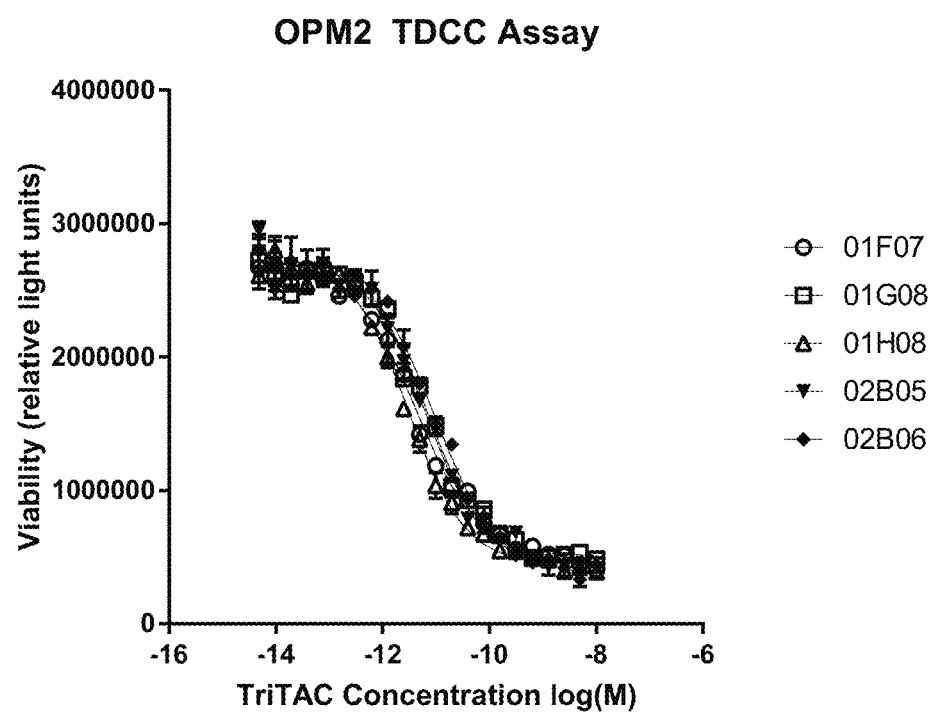
Figure 4H:
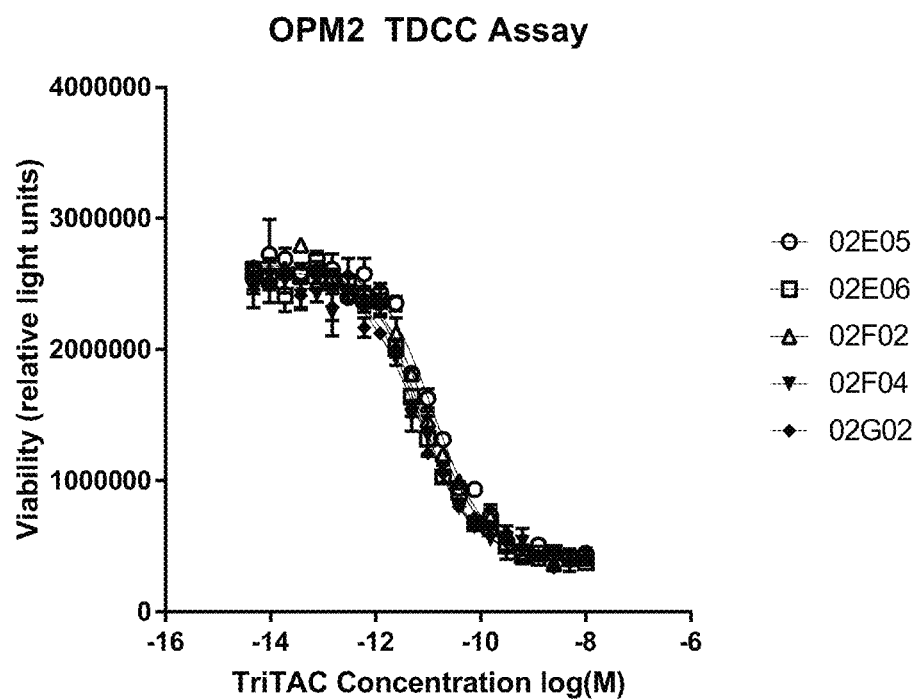
Figure 4I:
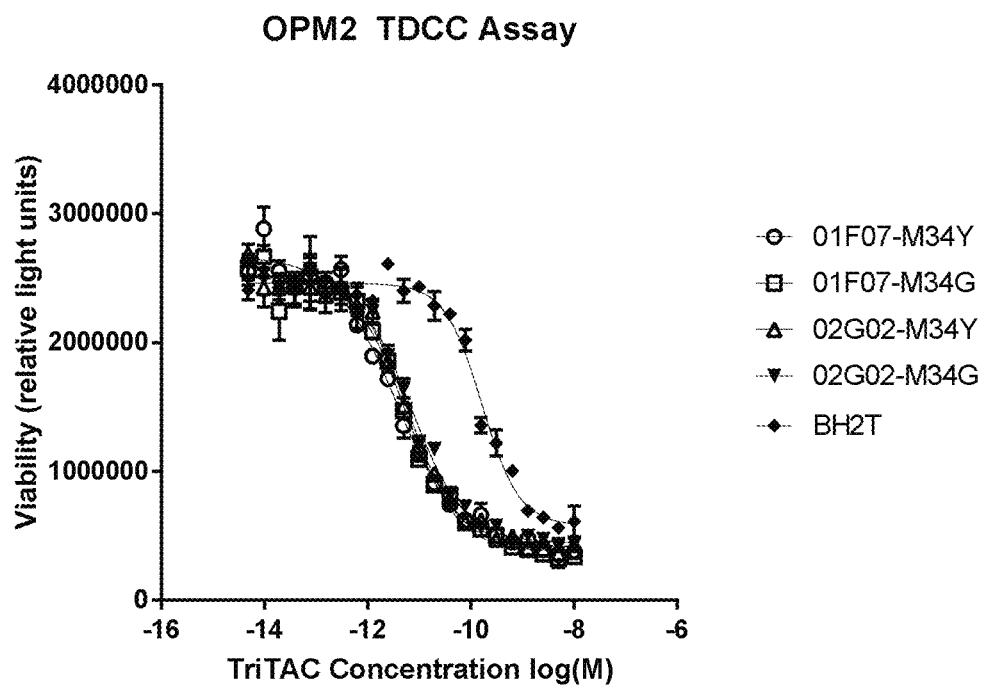

In this example EJM cells were used, which is a cell line that serves as an in vitro model for multiple myeloma and plasma cell leukemia. Viability of the EJM cells is measured after 48 hours. It was seen that the trispecific proteins mediated T cell killing. FIG. 2 shows an example cell viability assay with test proteins 01H08, 01F07, 02F02 and BH253 compared to a negative control. The $EC_{50}$ for the TDCC activity of several other test trispecific proteins are listed below in Table 1.

Binding Affinity

In the instant study, the binding affinity to human BCMA protein of the BCMA targeting trispecific proteins containing a BCMA binding protein according to the present disclosure was determined. The affinity measurements are listed in Table 1.

TABLE 1

Binding affinity and TDCC Activity of several BCMA targeting trispecific proteins.

| Construct Name | Human BCMA KD (M) | TDCC EC50 (M) |
| --- | --- | --- |
| 253BH10 | 2.77E−08 | 5.29E−11 |
| 01H08 | 2.86E−09 | 3.41E−13 |
| 01F07 | 4.18E−09 | 7.02E−13 |
| 01H06 | ND | 1.00E−12 |
| 02G02 | 5.26E−09 | 1.08E−12 |
| 02B05 | 5.39E−09 | 1.22E−12 |
| 01C01 | 6.52E−09 | 1.33E−12 |
| 02F02 | 6.73E−09 | 1.36E−12 |
| 02E05 | 6.53E−09 | 1.37E−12 |
| 01E08 | 5.56E−09 | 1.50E−12 |
| 02C01 | 5.31E−09 | 1.55E−12 |
| 02E06 | 6.31E−09 | 1.57E−12 |
| 02B06 | 6.77E−09 | 1.65E−12 |
| 02F04 | 6.75E−09 | 1.72E−12 |
| 01G08 | 6.27E−09 | 1.91E−12 |
| 02C06 | 6.90E−09 | 1.95E−12 |
| 01H09 | 5.44E−09 | 2.21E−12 |
| 01F04 | 6.55E−09 | 2.21E−12 |
| 01D02 | 7.35E−09 | 2.25E−12 |
| 02D11 | 6.71E−09 | 2.35E−12 |
| 01A07 | 6.95E−09 | 2.49E−12 |
| 02C03 | 7.09E−09 | 2.52E−12 |
| 02F07 | 7.06E−09 | 2.59E−12 |
| 01E04 | 7.29E−09 | 2.67E−12 |
| 02H09 | 6.83E−09 | 2.88E−12 |
| 01E03 | 6.36E−09 | 2.98E−12 |
| 02F05 | 7.15E−09 | 3.00E−12 |
| 01B05 | 6.52E−09 | 3.01E−12 |
| 01C05 | 6.09E−09 | 3.07E−12 |
| 02F12 | 7.76E−09 | 3.14E−12 |
| 01H11 | 7.06E−09 | 3.17E−12 |
| 02G06 | 7.50E−09 | 3.39E−12 |
| 01E06 | 8.91E−09 | 3.77E−12 |
| 01G11 | 9.70E−09 | 3.98E−12 |
| 02A05 | 7.06E−09 | 4.21E−12 |
| 01A08 | 1.17E−08 | 4.25E−12 |
| 02G05 | 7.12E−09 | 4.33E−12 |
| 01B09 | 1.12E−08 | 5.27E−12 |
| 01G01 | 1.46E−08 | 5.83E−12 |
| 01B06 | 9.10E−09 | 6.97E−12 |
| 01F10 | 1.44E−08 | 7.44E−12 |
| 01E05 | 1.17E−08 | 1.08E−11 |
| 02G01 | 1.63E−08 | 1.08E−11 |
| 01A06 | 1.58E−08 | 1.10E−11 |
| 02B04 | 1.52E−08 | 1.13E−11 |

TABLE 1-continued

Binding affinity and TDCC Activity of several BCMA targeting trispecific proteins.

| Construct Name | Human BCMA KD (M) | TDCC EC50 (M) |
|---|---|---|
| 01D06 | 1.49E−08 | 1.35E−11 |
| 02B07 | 1.58E−08 | 1.42E−11 |
| 02B11 | 1.33E−08 | 1.44E−11 |
| 01H04 | 1.74E−08 | 1.47E−11 |
| 01D03 | 2.09E−08 | 1.49E−11 |
| 01A05 | 1.70E−08 | 1.51E−11 |
| 02F11 | 2.00E−08 | 1.52E−11 |
| 01D04 | 1.89E−08 | 1.60E−11 |
| 01B04 | 1.86E−08 | 1.61E−11 |
| 02C05 | 1.56E−08 | 1.62E−11 |
| 02E03 | 1.68E−08 | 1.65E−11 |
| 01D05 | 1.78E−08 | 1.66E−11 |
| 01C04 | 2.16E−08 | 1.75E−11 |
| 01E07 | 1.99E−08 | 1.92E−11 |
| 01G06 | 1.70E−08 | 1.92E−11 |
| 02F06 | 2.19E−08 | 1.93E−11 |
| 01B01 | 1.99E−08 | 1.95E−11 |
| 01D07 | 1.93E−08 | 1.96E−11 |
| 02A08 | 9.51E−09 | 2.01E−11 |
| 01A02 | 2.15E−08 | 2.18E−11 |
| 02G11 | 2.05E−08 | 2.38E−11 |
| 01G04 | 1.17E−08 | 2.41E−11 |
| 02F03 | 2.57E−08 | 2.45E−11 |
| 01C06 | 1.88E−08 | 2.51E−11 |
| 01A01 | 2.13E−08 | 2.64E−11 |
| 01B12 | 2.07E−08 | 2.73E−11 |
| 02A07 | 1.84E−08 | 2.79E−11 |
| 02G08 | 1.80E−08 | 2.86E−11 |
| 02E09 | 2.09E−08 | 3.11E−11 |
| 02H06 | 2.33E−08 | 3.19E−11 |
| 01H10 | 2.48E−08 | 3.52E−11 |
| 01F05 | 1.67E−08 | 3.72E−11 |
| 01C02 | 2.00E−08 | 3.73E−11 |
| 02A04 | 1.76E−08 | 3.82E−11 |
| 02H05 | 1.96E−08 | 3.89E−11 |
| 02G09 | 3.44E−08 | 3.96E−11 |
| 02D06 | 2.33E−08 | 4.28E−11 |
| 02G07 | 1.93E−08 | 4.46E−11 |
| 01H05 | 2.74E−08 | 4.54E−11 |
| 01C08 | 2.83E−08 | 4.57E−11 |
| 01A03 | 3.08E−08 | 4.61E−11 |
| 01A09 | 2.39E−08 | 4.84E−11 |
| 02B01 | 2.14E−08 | 5.18E−11 |
| 02H01 | 3.56E−08 | 5.42E−11 |
| 02H04 | 3.11E−08 | 5.99E−11 |
| 02A11 | 2.52E−08 | 6.06E−11 |
| 01E10 | 1.85E−08 | 6.23E−11 |
| 02D09 | 2.89E−08 | 6.73E−11 |
| 01F08 | 2.14E−08 | 7.12E−11 |
| 01F03 | 1.50E−08 | 7.64E−11 |
| 02H11 | 2.75E−08 | 7.75E−11 |
| 01C07 | 1.98E−08 | 8.33E−11 |
| 01B08 | 2.56E−08 | 8.76E−11 |
| 01B03 | 2.62E−08 | 9.64E−11 |
| 01H01 | 3.59E−08 | 1.18E−10 |
| 02B12 | 2.52E−08 | 1.24E−10 |
| 01G10 | 4.19E−08 | 1.43E−10 |
| 01A04 | 3.75E−08 | 1.59E−10 |
| 01B07 | 4.39E−08 | 1.74E−10 |
| 01C10 | 4.64E−08 | 2.08E−10 |
| 01F02 | 4.13E−08 | 2.25E−10 |
| 01B02 | 1.88E−08 | 3.59E−10 |
| 01F12 | 4.05E−08 | 3.92E−10 |
| 01G09 | 8.78E−08 | 4.41E−10 |
| 01D10 | 5.39E−08 | 4.53E−10 |
| 01F09 | 5.28E−08 | 9.45E−10 |

ND: Not determined.

Molecules 01H08, 01F07, 01H06, 02G02, 02B05, 01C01, 02F02, 02E05, 01E08, 02C01, 02E06, 02B06, 02F04, 01G08, 02C06, 01H09, 01F04, 01D02, 02D11, 01A07, 02C03, 02F07, 01E04, 02H09, 01E03, 02F05, 01B05, 01C05, 02F12, 01H11, 02G06, 01E06, 01G11, 02A05, 01A08, 02G05, 01B09, 01G01, 01B06, 01F10, 01E05, 02G01, 01A06, 02B04, 01D06, 02B07, 02B11, 01H04, 01D03, 01A05, 02F11, 01D04, 01B04, 02C05, 02E03, 01D05, 01C04, 01E07, 01G06, 02F06, 01B01, 01D07, 02A08, 01A02, 02G11, 01G04, 02F03, 01C06, 01A01 have at least two fold increase TDCC potency and also show increase affinity compared to a molecule with the parental CDRs, 253BH10.

Molecules 01H08, 01F07, 01H06, 02G02, 02B05, 01C01, 02F02, 02E05, 01E08, 02C01, 02E06, 02B06, 02F04, 01G08, 02C06, 01H09, 01F04, 01D02, 02D11, 01A07, 02C03, 02F07, 01E04, 02H09, 01E03, 02F05, 01B05, 01C05, 02F12, 01H11, 02G06, 01E06, 01G11, 02A05, 01A08, 02G05, 01B09 have at least ten-fold increase TDCC potency and also show increase affinity compared to a molecule with the parental CDRs, 253BH10.

An anti-GFP trispecific molecule, included in these assays as a negative control, had no detectable BCMA binding and no effect on cell viability in the TDCC assay (data not shown).

Example 2

Methods to Assess Binding and Cytotoxic Activities of Exemplary BCMA Targeting Trispecific Proteins According to the Present Disclosure Against Jeko1, MOLP8 and OPM2 Cells Protein Production Sequences of BCMA targeting trispecific molecules, containing a BCMA binding protein according to the present disclosure, preceded by a leader sequence and followed by a 6× Histidine Tag (SEQ ID NO: 471), were expressed using the vectors and methods previously described (Running Deer and Allison, 2004. *Biotechnol Prog.* 20:880-9) except lipid based reagents and non-linearized plasmid DNA were used for cell transfection. Recombinant trispecific proteins were purified using affinity chromatography, ion exchange, and/or size exclusion chromatography. Purified protein was quantitated using theoretical extinction coefficients and absorption spectroscopy. An image of a Coomassie stained SDS-PAGE demonstrates the purity of the proteins (FIG. 3).

Cytotoxicity Assays

A human T-cell dependent cellular cytotoxicity (TDCC) assay was used to measure the ability of T cell engagers, including trispecific molecules, to direct T cells to kill tumor cells (Nazarian et al., 2015. *J. Biomol. Screen.,* 20:519-27). In this assay, T cells and target cancer cell line cells are mixed together at a 10:1 ratio in a 384-well plate, and varying amounts of the trispecific proteins being tested are added. The tumor cell lines are engineered to express luciferase protein. After 48 hours, to quantitate the remaining viable tumor cells, STEADY-GLO® Luminescent Assay (Promega) was used.

In the instant study, titrations of purified protein were added to TDCC assays (T cell Dependent Cell Cytotoxicity assays) to assess whether the ani-BCMA single domain antibody was capable of forming a synapse between T cells and BCMA-expressing Jeko1, MOLP8 and OPM2 cancer cell lines. Jeko1 is a Bcell lymphoma cell line. MOLP-8 is a myeloma cell line. OPM-2 is a human myeloma cell line.

Viability of the cells was measured after 48 hours. It was seen that the trispecific proteins mediated T cell killing. FIG. 4 shows an example cell viability assay with test proteins compared to a negative control. The $EC_{50}$ for the TDCC activity of several other test trispecific proteins are listed below in Table 2. An anti-GFP trispecific molecule, included in these assays as a negative control, had no effect on cell viability (data not shown).

TABLE 2

TDCC $EC_{50}$ Values for 3 Cell Lines for Select BCMA targeting trispecific proteins in TriTAC ™ format (anti-target (BCMA):anti-albumin:anti-CD3 binding domains).

| Construct name | Jeko1 EC50 (M) | MOLP-8 EC50 (M) | OPM-2 EC50 (M) |
| --- | --- | --- | --- |
| BH2T TriTAC ™ | 3.2E-10 | 2.0E-10 | 1.6E-10 |
| 01F07 TriTAC ™ | 5.3E-12 | 1.5E-12 | 4.4E-12 |
| 01F07-M34Y TriTAC ™ | 5.6E-12 | 1.5E-12 | 3.6E-12 |
| 01F07-M34G TriTAC ™ | 9.0E-12 | 2.2E-12 | 5.6E-12 |
| 01G08 TriTAC ™ | 1.5E-12 | 2.5E-12 | 6.9E-12 |
| 01H08 TriTAC ™ | 4.0E-12 | 9.4E-13 | 3.1E-12 |
| 02B05 TriTAC ™ | 8.3E-12 | 2.5E-12 | 6.5E-12 |
| 02B06 TriTAC ™ | 1.1E-11 | 2.8E-12 | 9.7E-12 |
| 02E05 TriTAC ™ | 1.1E-11 | 3.3E-12 | 1.2E-11 |
| 02E06 TriTAC ™ | 9.1E-12 | 2.4E-12 | 7.4E-12 |
| 02F02 TriTAC ™ | 8.2E-12 | 3.5E-12 | 1.0E-11 |
| 02F04 TriTAC ™ | 1.0E-11 | 2.5E-12 | 7.3E-12 |
| 02G02 TriTAC ™ | 1.1E-11 | 2.8E-12 | 6.6E-12 |
| 02G02-M34Y TriTAC ™ | 1.1E-11 | 5.6E-12 | 6.2E-12 |
| 02G02-M34G TriTAC ™ | 1.2E-11 | 4.0E-12 | 7.1E-12 |

Binding Affinity

In the instant study, the binding affinity to human BCMA protein of the BCMA targeting trispecific proteins containing a BCMA binding protein according to the present disclosure was determined.

TABLE 3

Binding affinity of purified targeting trispecific proteins containing a BCMA binding protein according to the present disclosure.

| Construct name | Human BCMA $K_D$ (M) |
| --- | --- |
| 01F07-M34Y TriTAC ™ | 3.0E-09 |
| 01F07-M34G TriTAC ™ | 6.0E-09 |
| 02B05 TriTAC ™ | 6.0E-09 |
| 02G02-M34Y TriTAC ™ | 5.0E-09 |
| 02G02-M34G TriTAC ™ | 7.0E-09 |

The data in FIG. 3, FIG. 4, Table 2 and Table 3 indicate the BCMA targeting trispecific proteins can be expressed and purified to greater than 90% purity. The purified proteins exhibit about 13 fold to 213 fold more potent TDCC activity compared to a trispecific protein with the parent BCMA targeting sequence. The purified trispecific proteins bind to BCMA with affinity of about 3 to 7 nM.

Example 3

Xenograft Tumor Model

An exemplary BCMA targeting trispecific protein described herein was evaluated in a xenograft model.

Figure 30:
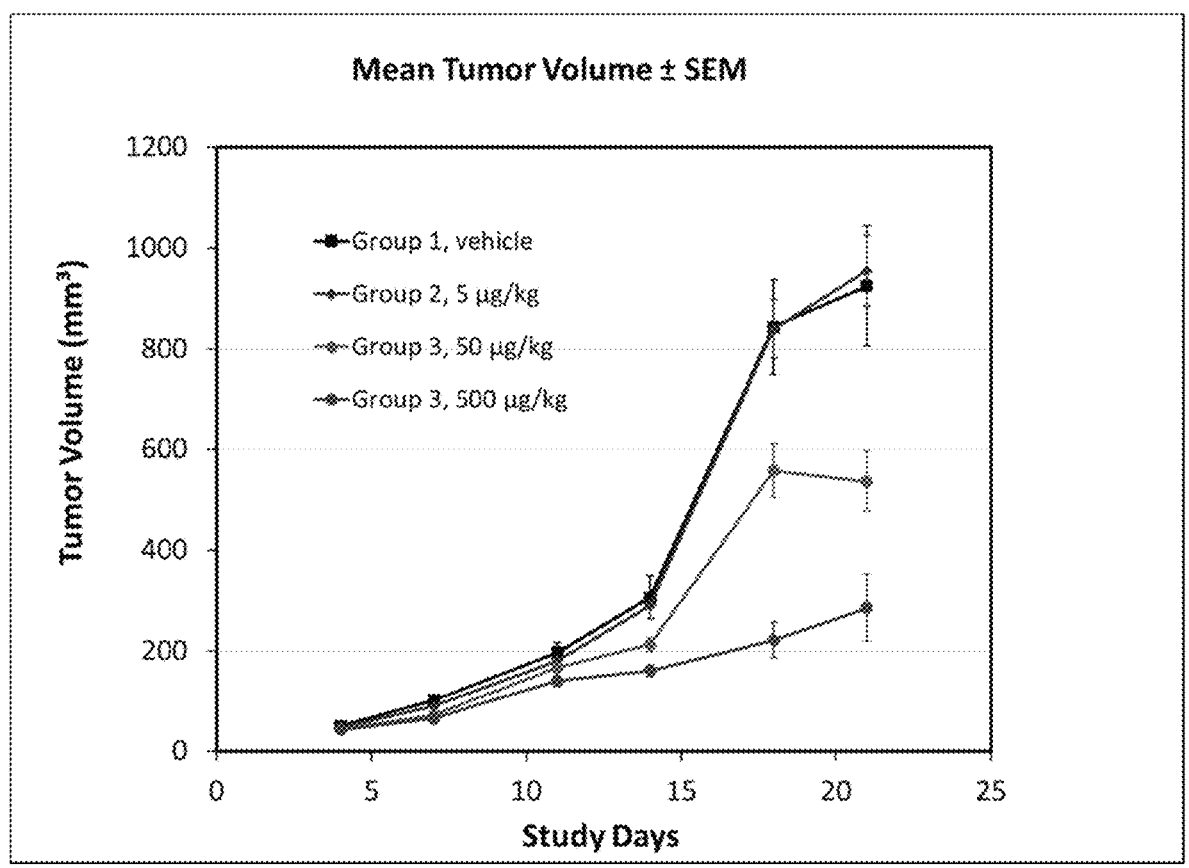
FIG. 30 illustrates tumor growth reduction in RPMI8226 xenograft model, treated with an exemplary BCMA targeting trispecific (02B05) protein, at varying concentrations, or with a control vehicle.

On day 0, NCG mice were subcutaneously inoculated with RPMI-8226 cells, and also intraperitoneally implanted with normal human peripheral blood mononuclear cells (PBMCs). Treatment with an exemplary BCMA targeting trispecific protein (02B05) (SEQ ID NO: 520) was also started on day 0 (qd×10) (once daily for 10 days). The dosage of administration was 5 µg/kg, 50 µg/kg, or 500 µg/kg of the BCMA targeting trispecific protein 02B05, or a vehicle as control. Tumor volumes were determined for 25 days. As shown in FIG. 30, the mean tumor volumes were significantly lower in mice treated with the exemplary BCMA targeting trispecific protein (02B05) (at 50 µg/kg, or 500 µg/kg), as compared to the mice treated with the vehicle or the lower dose of BCMA targeting trispecific protein (02B05) (at 5 µg/kg).

Figure 31:
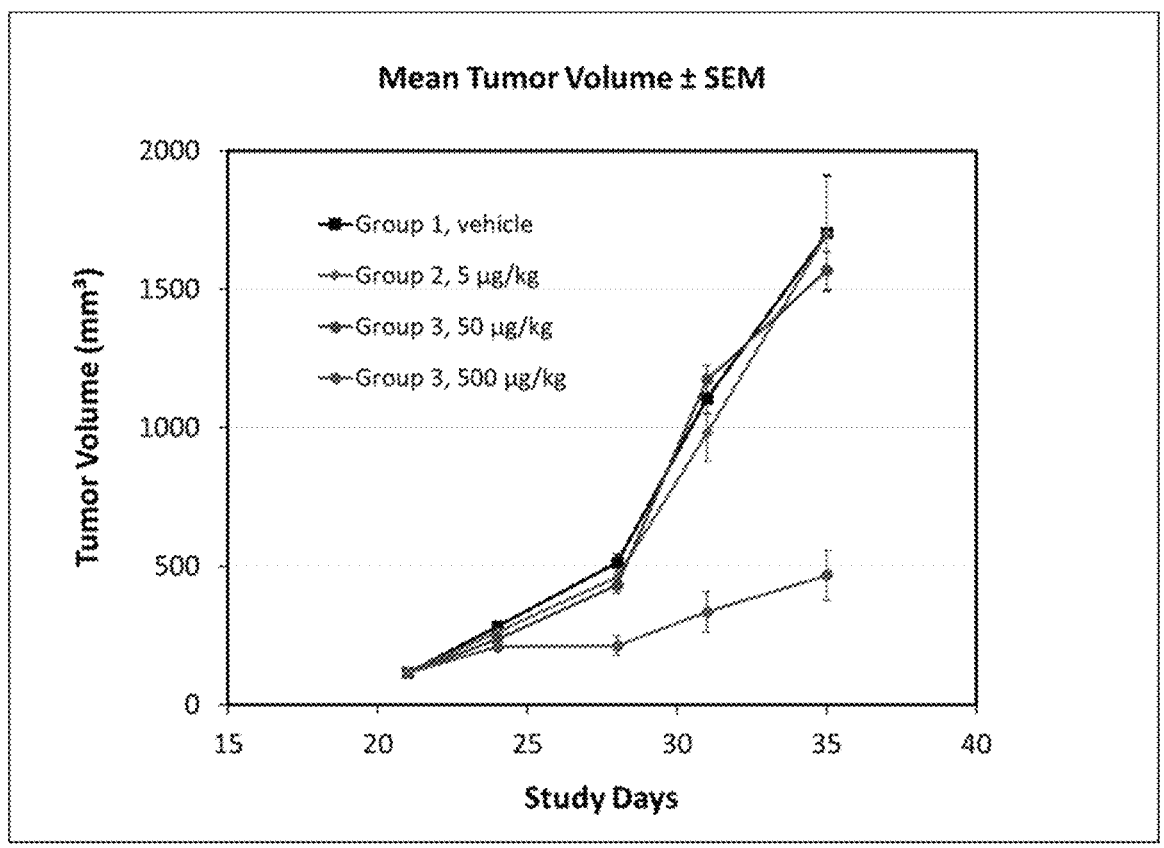
FIG. 31 illustrates tumor growth reduction in Jeko1 xenograft model, treated with an exemplary BCMA targeting trispecific (02B05) protein, at varying concentrations, or with a control vehicle.

On day 0, NCG mice were subcutaneously inoculated with Jeko 1 cells, and also intraperitoneally implanted with normal human peripheral blood mononuclear cells (PBMCs). Treatment with an exemplary BCMA targeting trispecific protein (02B05) (SEQ ID NO: 520) was started on day 3 (qd×10) (once daily for 10 days). The dosage of administration was 5 µg/kg, 50 µg/kg, or 500 µg/kg of the BCMA targeting trispecific protein 02B05, or a vehicle as control. Tumor volumes were determined for 25 days. As shown in FIG. 31, the mean tumor volumes were significantly lower in mice treated with the exemplary BCMA targeting trispecific protein (02B05) (at 500 µg/kg), as compared to the mice treated with the vehicle or the lower doses of BCMA targeting trispecific protein (02B05) (at 5 µg/kg or 50 µg/kg).

Example 4

Proof-of-Concept Clinical Trial Protocol for Administration of a BCMA Trispecific Antigen-Binding Protein of this Disclosure Multiple Myeloma Patients This is a Phase I/II clinical trial for studying the BCMA trispecific antigen-binding protein of Example 1 as a treatment for Multiple Myeloma.

Study Outcomes:

Primary: Maximum tolerated dose of BCMA targeting trispecific proteins of the previous examples Secondary: To determine whether in vitro response of BCMA targeting trispecific proteins of is the previous examples are associated with clinical response Phase I The maximum tolerated dose (MTD) will be determined in the phase I section of the trial.

1.1 The maximum tolerated dose (MTD) will be determined in the phase I section of the trial.

1.2 Patients Who Fulfill Eligibility Criteria Will be Entered into the Trial to BCMA Targeting Trispecific Proteins of the Previous Examples.

1.3 The goal is to identify the highest dose of BCMA targeting trispecific proteins of the previous examples that can be administered safely without severe or unmanageable side effects in participants. The dose given will depend on the number of participants who have been enrolled in the study prior and how well the dose was tolerated. Not all participants will receive the same dose.

Phase II 2.1 A subsequent phase II section will be treated at the MTD with a goal of determining if therapy with therapy of BCMA targeting trispecific proteins of the previous examples results in at least a 20% response rate.

Primary Outcome for the Phase II—To determine if therapy of BCMA targeting trispecific proteins of the previous examples results in at least 20% of patients achieving a clinical response (blast response, minor response, partial response, or complete response)

Eligibility

Eligibility criteria for inclusion in the studies are as follows:

Previously untreated patients with multiple myeloma and without serious or imminent complications (e.g. impending pathologic fracture, hypercalcemia, renal insufficiency). All asymptomatic patients with low or intermediate tumor mass will qualify.

Patients with high tumor mass, symptomatic or impending fractures, hypercalcemia (corrected calcium>11.5 mg %), anemia (Hgb<8.5 gm/dl), renal failure (creatinine>2.0 mg/dl), high serum lactate dehydrogenase (>300 U/L) or plasma cell leukemia (>1000/ul) are ineligible.

Overt infections or unexplained fever should be resolved before treatment. Adequate liver function (including SGPT, bilirubin and LDH) is required.

Patients must have Zubrod performance of 1 or less.

Patients must provide written informed consent indicating that they are aware of the investigational nature of this study.

Life expectancy should exceed 1 year.

Patients with idiopathic monoclonal gammopathy and non-secretory multiple myeloma are ineligible. Patients whose only prior therapy has been with local radiotherapy, alpha-IFN, or ATRA are eligible. Patients exposed to prior high-dose glucocorticoid or alkylating agent are not eligible.

Example 5

Affinity Measurements for Human and Cynomolgus BCMA, CD3R, and Albumin, Using an Exemplary BCMA Targeting Trispecific Protein of this Disclosure The aim of this study was to assess the affinity of an exemplary BCMA targeting trispecific protein of this disclosure (02B05) (SEQ ID NO: 520), toward human BCMA, cynomolgus BCMA, human CD3, cynomolgus CD3, human albumin, cynomolgus albumin, and mouse albumin. The affinities were measured using an Octet instrument. For these measurements, streptavidin tips were first loaded with 2.5 nM human BCMA-Fc, 2.5 nM cynomologus BCMA-Fc, 2.5 nM human CD3ε-Fc, 2.5 nM cynomolgus CD3ε-Fc, 50 nM human serum albumin (HSA), 50 nM cynomolgus serum albumin, or 50 nM mouse serum albumin. Subsequently, the exemplary BCMA targeting trispecific protein 02B05 was incubated with the tips, and following an association period, the tips were moved to a buffer solution to allow the exemplary BCMA targeting trispecific protein (02B05) to disassociate. The affinities for binding to human and cynomolgus BCMA and CD3ε were measured in the presence of 15 mg/ml human serum albumin. Average calculated $K_D$ values from these studies are provided in Table 4 (n indicates the number of independent measurements, n/d indicates no binding detected under the conditions tested). Binding was detected to human BCMA, human CD3, cynomolgus CD3, human serum albumin, cynomolgus serum albumin, and mouse serum albumin. Under the conditions tested, no binding was detected to cynomolgus BCMA.

TABLE 4

Measured $K_D$ values for exemplary BCMA targeting trispecific protein 02B05 to protein ligands.

| Protein ligand | Species | $K_D$ (nM) | n |
|---|---|---|---|
| BCMA | human | 2.4 ± 0.2 | 2 |
| | cynomolgus | n/d | 2 |
| CD3ε | human | 8 ± 1 | 2 |
| | cynomolgus | 7.8 ± 0.4 | 2 |

TABLE 4-continued

Measured $K_D$ values for exemplary BCMA targeting trispecific protein 02B05 to protein ligands.

| Protein ligand | Species | $K_D$ (nM) | n |
|---|---|---|---|
| Albumin | human | 6 ± 1 | 3 |
| | cynomolgus | 7.5 | 1 |
| | mouse | 76 | 1 |

Example 6

Human T Cell Binding Ability of an Exemplary BCMA Targeting Trispecific Protein of this Disclosure Exemplary BCMA targeting trispecific protein 02B05 (SEQ ID NO: 520) was tested for its ability to bind to purified T cells. Briefly, the BCMA trispecific protein or phosphate buffered saline (PBS) were incubated with purified T cells from 4 different anonymous human donors. After washing unbound protein, the T cells were then incubated with an Alexa Fluor 647 conjugated antibody that recognizes the anti-albumin domain in the 02B05 BCMA trispecific antigen-binding protein. The T cells were then analyzed by flow cytometry. It was observed that human T cells incubated with the 02B05 BCMA trispecific antigen-binding protein had notable shifts associated with Alexa Fluor 647 staining compared to cells that were incubated with PBS. The results are shown in FIGS. 5A, 5B, 5C, and 5D. In conclusion, this study indicated that the exemplary BCMA targeting trispecific protein was able to bind human T cells.

Example 7

Ability of an Exemplary BCMA Targeting Trispecific Protein of this Disclosure to Bind BCMA Expressing Cells Exemplary BCMA targeting trispecific protein 02B05 (SEQ ID NO: 520) was tested for its ability to bind to BCMA expressing cells. Briefly, the 02B05 BCMA trispecific antigen-binding protein was incubated with cell lines expressing BCMA (NCI-H929; EJM; RPMI-8226; OPM2) or lacking BCMA (NCI-H510A; DMS-153). Expression of BCMA RNA in these cells is indicated by the FPKM (fragments per kilobase million) values listed in FIGS. 6A-F: the RNA FPKM values are from the Cancer Cell Line Encyclopedia (Broad Institute, Cambridge, Mass. USA). After washing unbound protein, the cells were then incubated with an Alexa Fluor 647 conjugated antibody that recognizes the anti-albumin domain in the 02B05 BCMA trispecific antigen-binding protein. The cells were then analyzed by flow cytometry. As a negative control, cells were incubated with a trispecific protein targeting GFP. Cells expressing BCMA RNA and incubated with the BCMA trispecific protein had notable shifts associated with Alexa Fluor 647 staining compared to cells that were incubated with GFP trispecific protein (as in FIGS. 6A, 6B, 6D, and 6E). Whereas, cells lacking BCMA RNA produced equivalent Alexa Fluor 647 staining with the BCMA trispecific protein and the GFP trispecific protein (as seen in FIGS. 6C, and 6F). Thus, this study indicated that the exemplary BCMA trispecific antigen-binding was able to selectively bind to cells expressing BCMA.

Example 8

Figure 7:
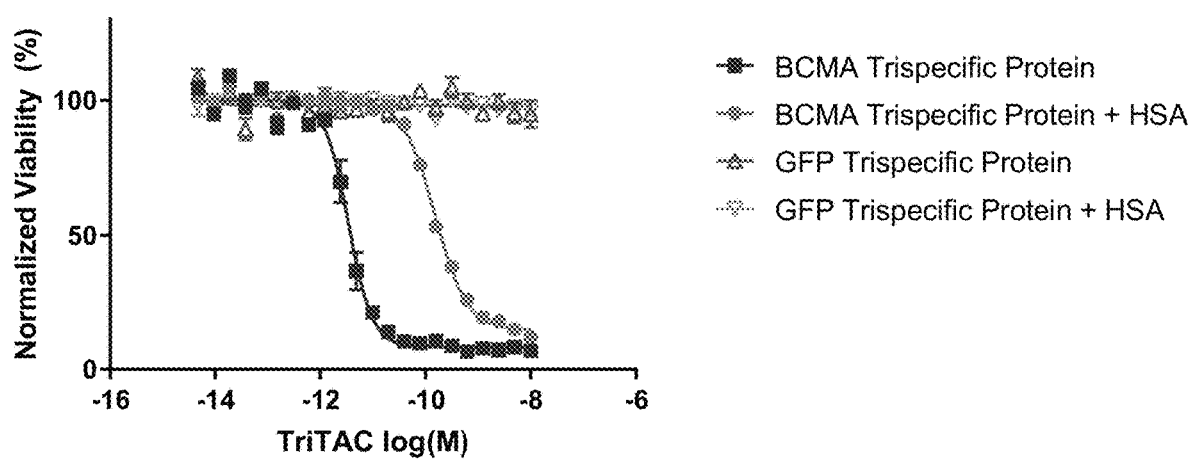
FIG. 7 illustrates the results of a TDCC assay using an exemplary BCMA trispecific targeting protein (02B05) and BCMA expressing EJM cells, in presence or absence of human serum albumin (HSA).

Ability of an Exemplary BCMA Targeting Trispecific Protein to Mediate T Cell Killing of Cancer Cells Expressing BCMA Exemplary BCMA trispecific protein 02B05 (SEQ ID NO: 520) was tested for its ability to direct T cells to kill BCMA expressing cells in the presence and absence of human serum albumin (HSA) using a standard TDCC assay as described in Example 1. Because the exemplary BCMA trispecific protein contains an anti-albumin domain, this experiment was performed to confirm that binding to albumin would not prevent the BCMA trispecific antigen-binding protein from directing T cells to kill BCMA expressing cells. Five BCMA expressing cell lines were tested: EJM, Jeko, OPM2, MOLP8, and NCI-H929. Representative data for an experiment with the EJM cells are shown in FIG. 7. It was observed that viability of the EJM cells decreased with increasing amount of the exemplary 02B05 BCMA trispecific antigen-binding protein in the presence or absence of human serum albumin (HSA), whereas a control GFP targeting trispecific protein did not affect cell viability. In the presence of albumin, higher concentrations of BCMA trispecific protein were needed to reduce viability of the EJM cells. The $EC_{50}$ values for cell killing by BCMA trispecific protein for the EJM cells as well as the Jeko, OPM2, MOL8, and NCI-H929 cells in the absence or presence of HSA are provided in Table 5. With all five cell lines, the exemplary 02B05 BCMA trispecific antigen-binding protein directed T cells to kill target cells in the presence of HSA.

TABLE 5

TDCC $EC_{50}$ Values for an exemplary BCMA targeting trispecific protein in the presence or absence of human serum albumin with five different BCMA expressing cell lines

| Cell Line | $EC_{50}$ without HSA (pM) | $EC_{50}$ with HSA (pM) |
|---|---|---|
| EJM | 1.0 | 53 |
| Jeko | 8.3 | 662 |
| OPM2 | 6.5 | 328 |
| MOLP8 | 2.5 | 388 |
| NCI-H929 | 6.7 | 194 |

Example 9

Figure 8:
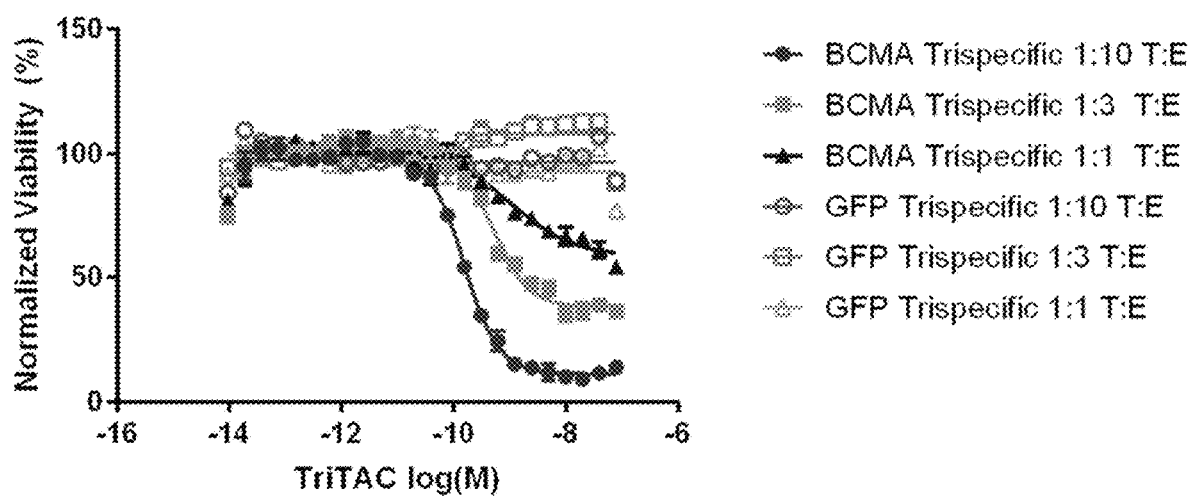
FIG. 8 illustrates the results of a TDCC assay using an exemplary BCMA trispecific targeting protein (02B05) and BCMA expressing EJM cells, using a varying effector cells to target cells ratio.
Figure 9:
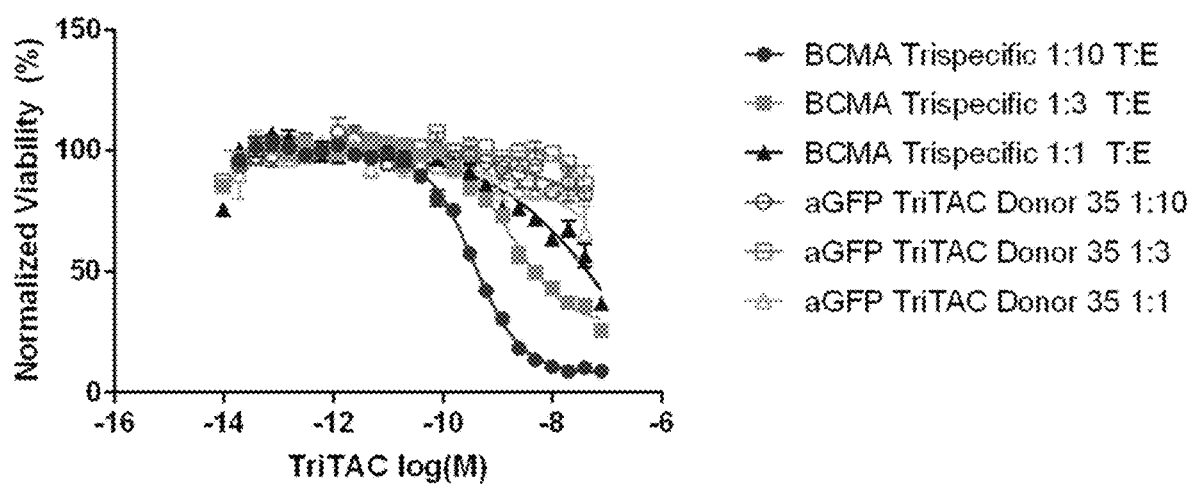
FIG. 9 illustrates the results of a TDCC assay using an exemplary BCMA trispecific targeting protein (02B05) and BCMA expressing OPM2 cells, using a varying effector cells to target cells ratio.

Ability of an Exemplary BCMA Targeting Trispecific Protein to Mediate T Cell Killing of Cancer Cells Expressing BCMA, Using a Smaller Target Cell to Effector Cell Ratio In the standard TDCC assay (as described in Example 1), a ratio 1 target cell (EJM cells or OPM2 cells) per 10 effector cells (T cells) is used in a 48 hour assay. In this experiment, the ability of exemplary BCMA trispecific protein 02B05 (SEQ ID NO: 520) to direct T cells to kill target cells with smaller target cell to effector ratios was tested. The expectation was that less killing would be observed when fewer effector cells were used. Two BCMA expressing cell lines were tested, EJM and OPM2, using target to effector cell ratios of 1:1, 1:3, and 1:10, and the experiment was performed in the presence of 15 mg/ml HSA. A GFP targeting trispecific protein was used as a negative control. Data from this experiment is shown in FIG. 8 (TDCC assay with EJM cells) and FIG. 9 (TDCC assay with OPM2 cells). As expected, near complete killing of the target cells was observed with a 1:10 target to effector cell ratio. The amount of killing was reduced with decreasing effector cells. The $EC_{50}$ values for cell killing with each ratio are listed in Table 6 (n/d indicates insufficient killing was observed to calculate an $EC_{50}$ value). The $EC_{50}$ values increased when fewer effector cells were present. Thus, as expected, reducing the number of effector cells to target cells reduced TDCC activity of the BCMA trispecific protein.

TABLE 6

TDCC $EC_{50}$ values for an exemplary BCMA targeting trispecific protein (02B05) with varied target cell (EJM cells) to effector cell (T cells) ratios (tested in presence of 15 mg/ml HSA)

| Target cell: T Cell ratio | EJM $EC_{50}$ (pM) | OPM2 $EC_{50}$ (pM) |
|---|---|---|
| 1:10 | 154 | 371 |
| 1:3 | 523 | 1896 |
| 1:1 | 1147 | n/d |

Example 10

Figure 10:
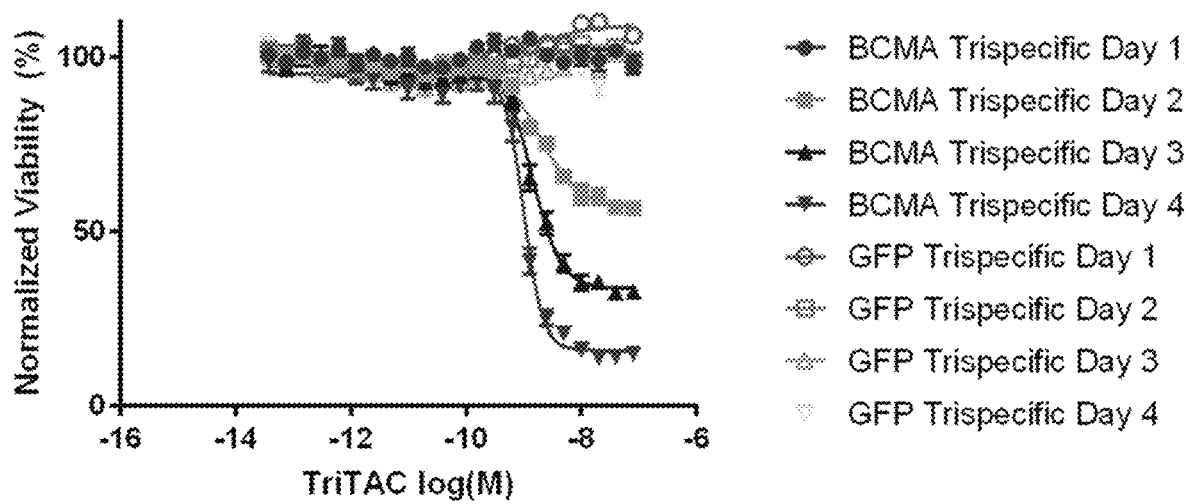
FIG. 10 illustrates the results of a TDCC assay using an exemplary BCMA trispecific targeting protein (02B05) and BCMA expressing NCI-H929 cells, using varying timepoints and a 1:1 effector cells to target cells ratio.
Figure 11:
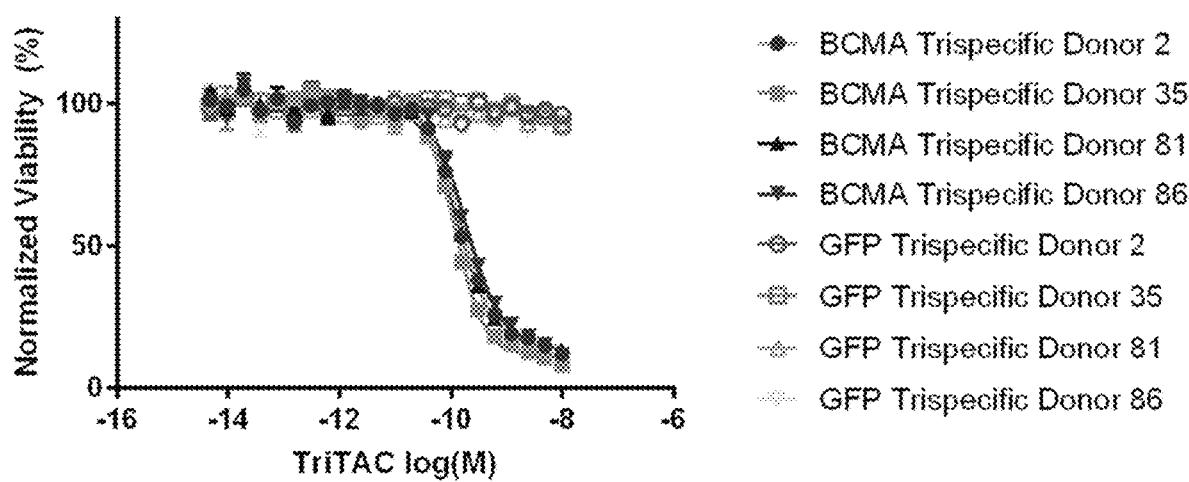
FIG. 11 illustrates the results of a TDCC assay using an exemplary BCMA trispecific targeting protein (02B05), BCMA expressing EJM cells, and T cells from four different donors, in presence of human serum albumin (HSA).
Figure 12:
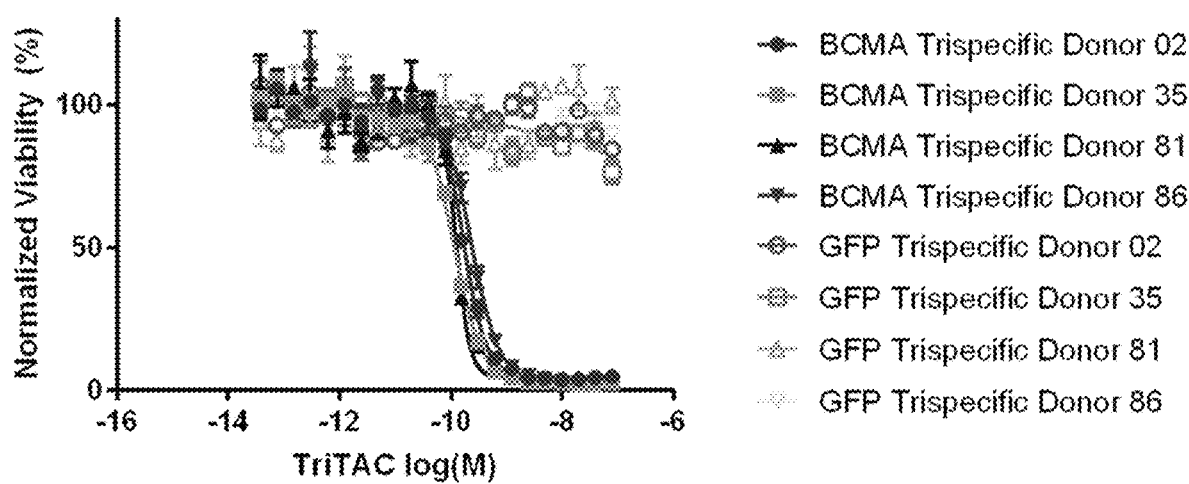
FIG. 12 illustrates the results of a TDCC assay using an exemplary BCMA trispecific targeting protein (02B05), BCMA expressing NCI-H929 cells, and T cells from four different donors, in presence of human serum albumin (HSA).
Figure 13:
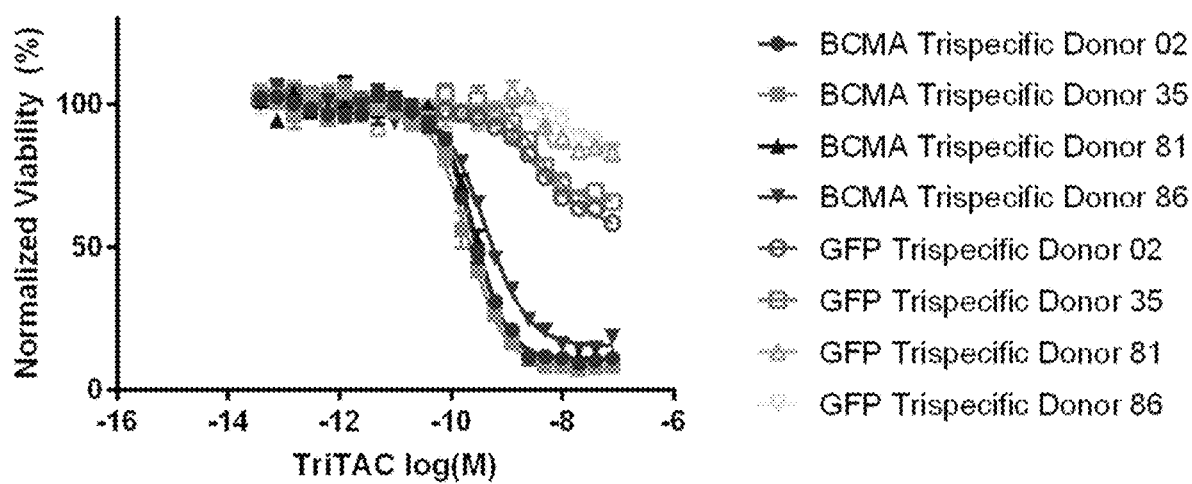
FIG. 13 illustrates the results of a TDCC assay using an exemplary BCMA trispecific targeting protein (02B05), BCMA expressing OPM2 cells, and T cells from four different donors, in presence of human serum albumin (HSA).
Figure 14:
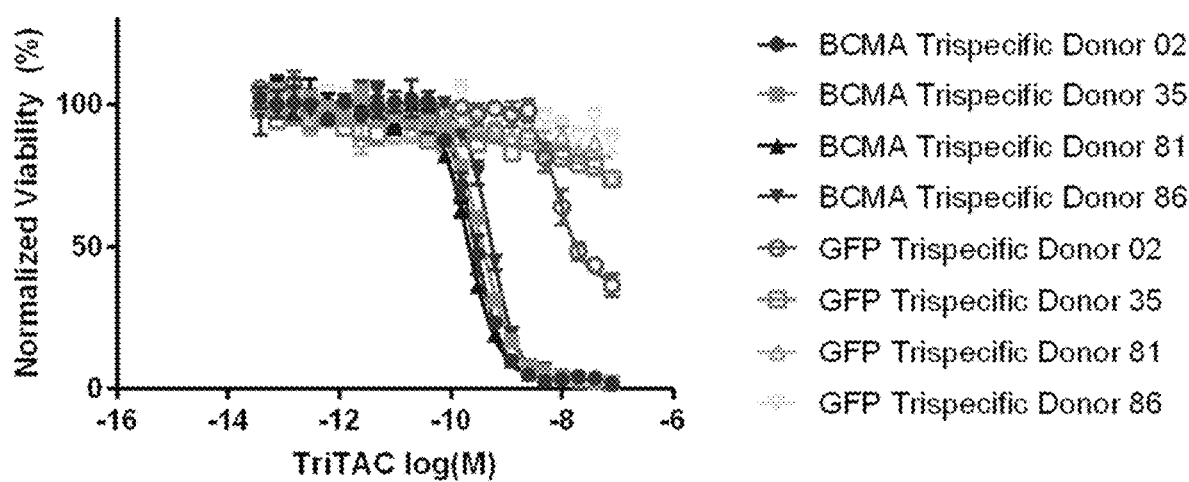
FIG. 14 illustrates the results of a TDCC assay using an exemplary BCMA trispecific targeting protein (02B05), BCMA expressing RPMI8226 cells, and T cells from four different donors, in presence of human serum albumin (HSA).

Ability of an Exemplary BCMA Targeting Trispecific Protein to Mediate T Cell Killing of Cancer Cells Expressing BCMA, in a Time Course Study, Using a Smaller Target Cell to Effector Cell Ratio In the standard TDCC assay (Example 1), a ratio 1 target cell per 10 effector cells (T cells) is used in a 48 hour assay. In this experiment, a time course was performed using a 1 to 1 ratio of target cells (EJM cells) to effector cells (T cells). The expectation was that with increased time, a 1 to 1 ratio would result in target cell killing. The experiment was performed in the presence of 15 mg/ml HSA. A GFP targeting trispecific protein was used as a negative control. Target cell viability was measured on days 1, 2, 3, and 4 following incubation of the target cells and effector cells, at a 1:1 ratio, in presence of the exemplary 02B05 BCMA trispecific antigen-binding protein and 15 mg/ml HSA, or the GFP targeting trispecific protein and 15 mg/ml HSA. While no target cell killing was observed on day 1, killing was observed at all other time points in the presence of the BCMA trispecific antigen-binding protein, with the amount of killing increasing with time (FIG. 10). Killing with not observed with the GFP targeting trispecific protein. The $EC_{50}$ values calculated for cell killing on each day are provided in Table 7 (n/d indicates insufficient killing to determine an $EC_{50}$ value). From this study it was concluded that the exemplary 02B05 BCMA trispecific protein was able to direct T cell killing with lower numbers of effector cells, but more time was needed to achieve more complete killing.

TABLE 7

TDCC $EC_{50}$ values for an exemplary BCMA targeting trispecific protein (02B05) with a 1 to 1 target cell (EJM cells) to effector cell (T cells) ratios (tested in presence of 15 mg/ml HSA), at varied time points

| | $EC_{50}$ (pM) |
|---|---|
| Day 1 | n/d |
| Day 2 | 1859 |
| Day 3 | 1420 |
| Day 4 | 1012 |

Example 11

Figure 15:
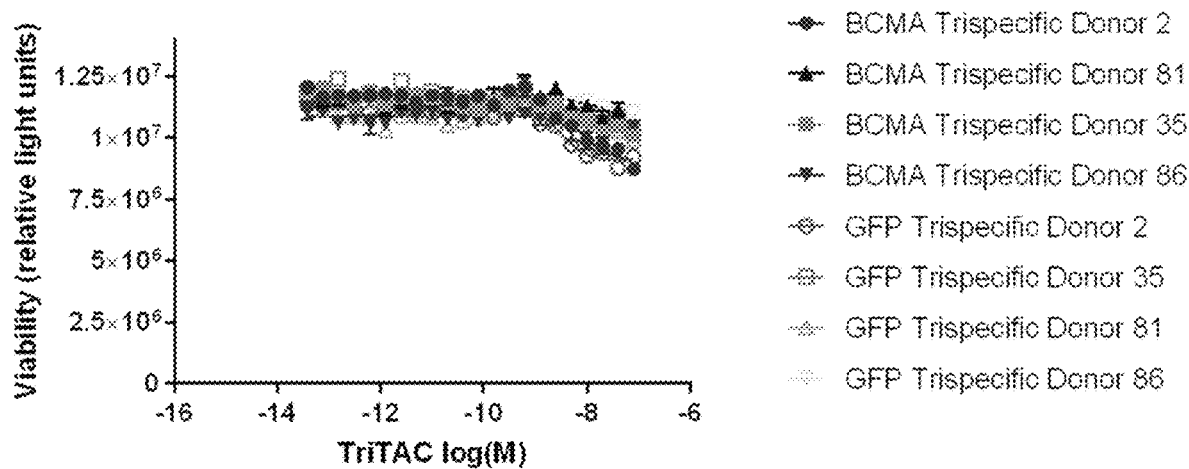
FIG. 15 illustrates the results of a TDCC assay using an exemplary BCMA trispecific targeting protein (02B05), BCMA non-expressing OVCAR8 cells, and T cells from four different donors, in presence of human serum albumin (HSA).
Figure 16:
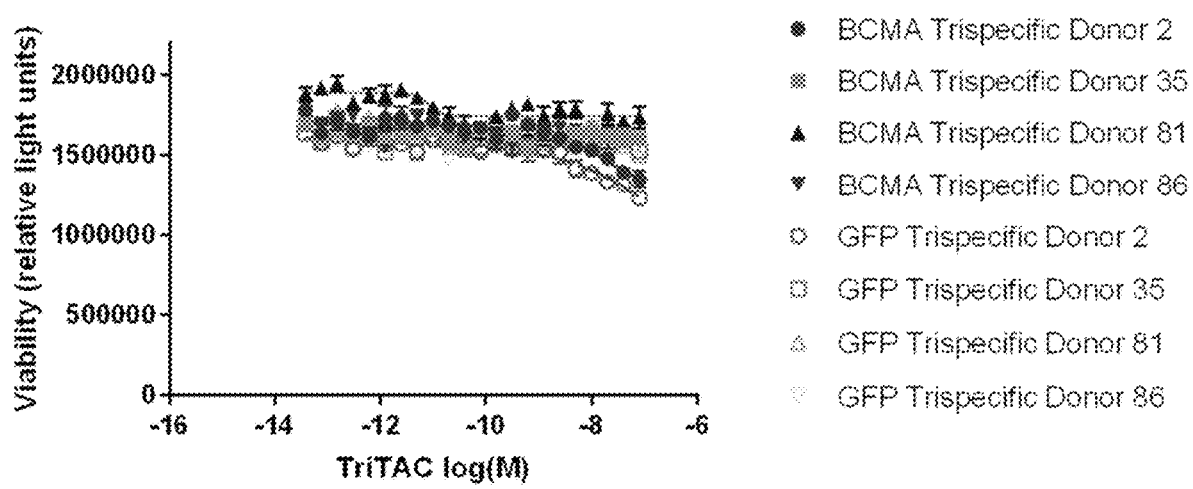
FIG. 16 illustrates the results of a TDCC assay using an exemplary BCMA trispecific targeting protein (02B05), BCMA non-expressing NCI-H510A cells, and T cells from four different donors, in presence of human serum albumin (HSA).

Ability of an Exemplary BCMA Targeting Trispecific Protein to Direct Human T Cells to Kill BCMA Expressing Cells Exemplary BCMA trispecific protein 02B05 (SEQ ID NO: 520) was tested for its ability to direct T cells from four different anonymous human donors to kill four different BCMA expressing cells in the presence of 15 mg/ml human serum albumin (HSA) using a standard TDCC assay as described in Example 1. The BCMA expressing cell lines were EJM, NCI-H929, OPM2, and RPMI8226. As negative controls, two cell lines that lack BCMA expression, OVCAR8 and NCI-H510A, were also tested in the TDCC assays. A control GFP targeting trispecific protein was also used as a negative control. With the four BCMA expressing cell lines and all four T cell donors, cell viability decreased with increasing amounts of the BCMA trispecific protein but not with the GFP trispecific protein (FIGS. 11, 12, 13, and 14). The $EC_{50}$ values for cell killing are provided in Table 8. The exemplary 02B05 BCMA trispecific antigen-binding protein did not direct killing of the cell lines lacking BCMA expression (FIGS. 15 and 16). Thus, it was inferred that the exemplary 02B05 BCMA trispecific antigen-binding protein was able to direct T cells from multiple donors to kill a spectrum of BCMA expressing cell lines.

TABLE 8

Exemplary 02B05 BCMA trispecific protein $EC_{50}$ values from TDCC assays with four BCMA expressing cell lines and four T cell donors in presence of 15 mg/ml HSA

| | EC50 (pM) | | | |
|---|---|---|---|---|
| | H929 | OPM2 | RPMI8226 | EJM |
| Donor 02 | 169 | 250 | 275 | 151 |
| Donor 35 | 113 | 199 | 371 | 121 |
| Donor 81 | 124 | 265 | 211 | 143 |
| Donor 86 | 239 | 416 | 543 | 191 |

Example 12

Figure 17:
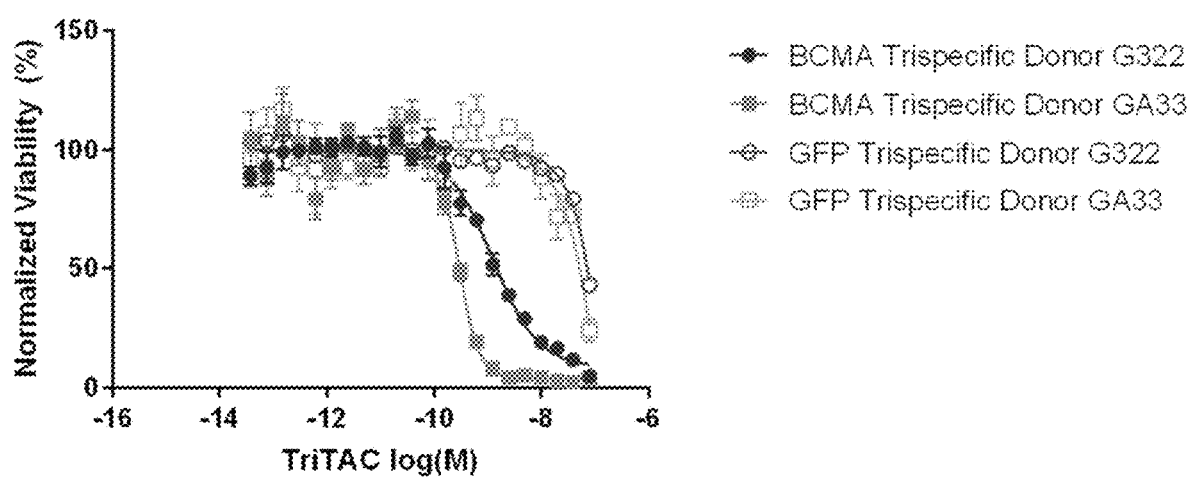
FIG. 17 illustrates the results of a TDCC assay using an exemplary BCMA trispecific targeting protein (02B05), BCMA expressing NCI-H929 cells, and peripheral blood mononuclear cells (PBMC) from two different cynomolgus donors, in presence of human serum albumin (HSA).
Figure 18:
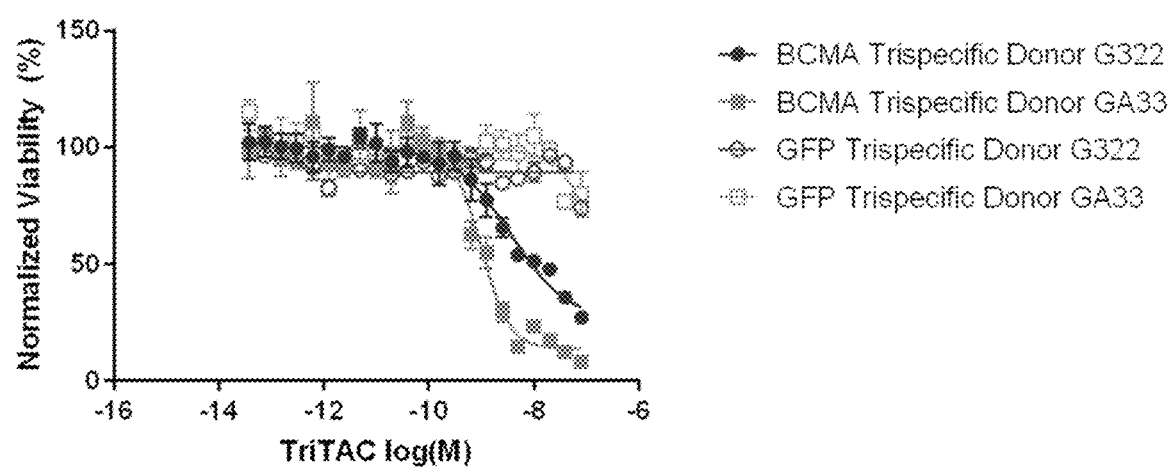
FIG. 18 illustrates the results of a TDCC assay using an exemplary BCMA trispecific targeting protein (02B05), BCMA expressing RPMI8226 cells, and peripheral blood mononuclear cells (PBMC) from two different cynomolgus donors, in presence of human serum albumin (HSA).
Figure 19:
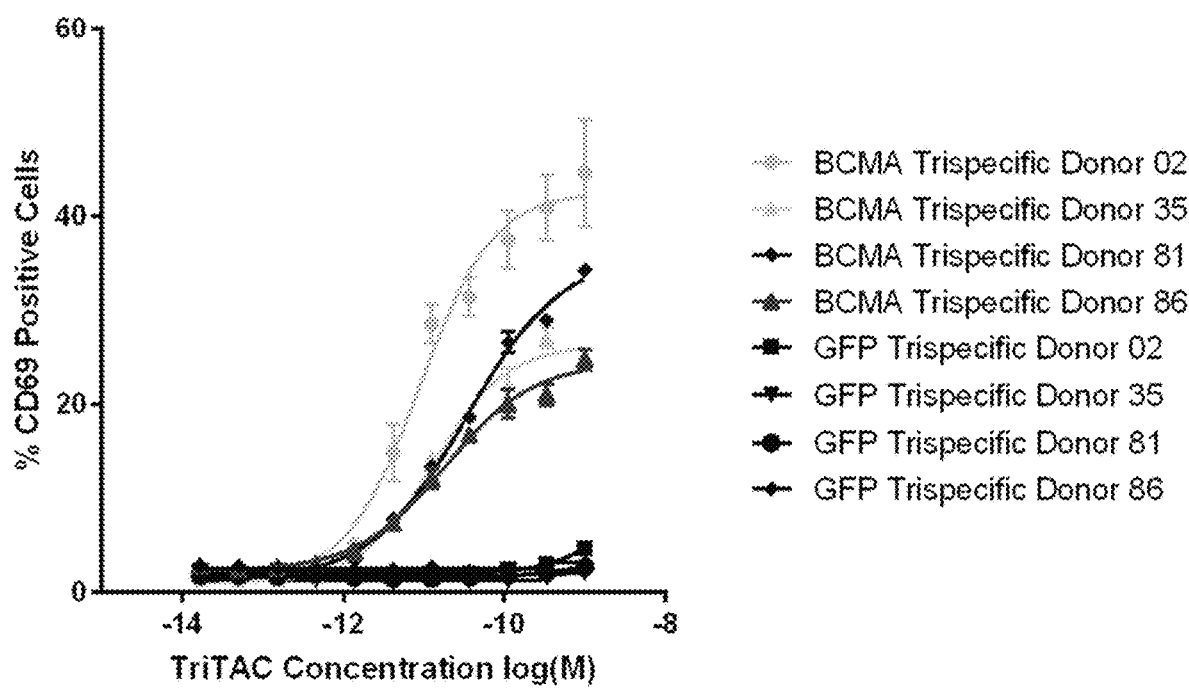
FIG. 19 illustrates the expression level of T cell activation biomarker CD69, following a TDCC assay using an exemplary BCMA targeting trispecific protein (02B05) and BCMA expressing cells EJM.
Figure 20:
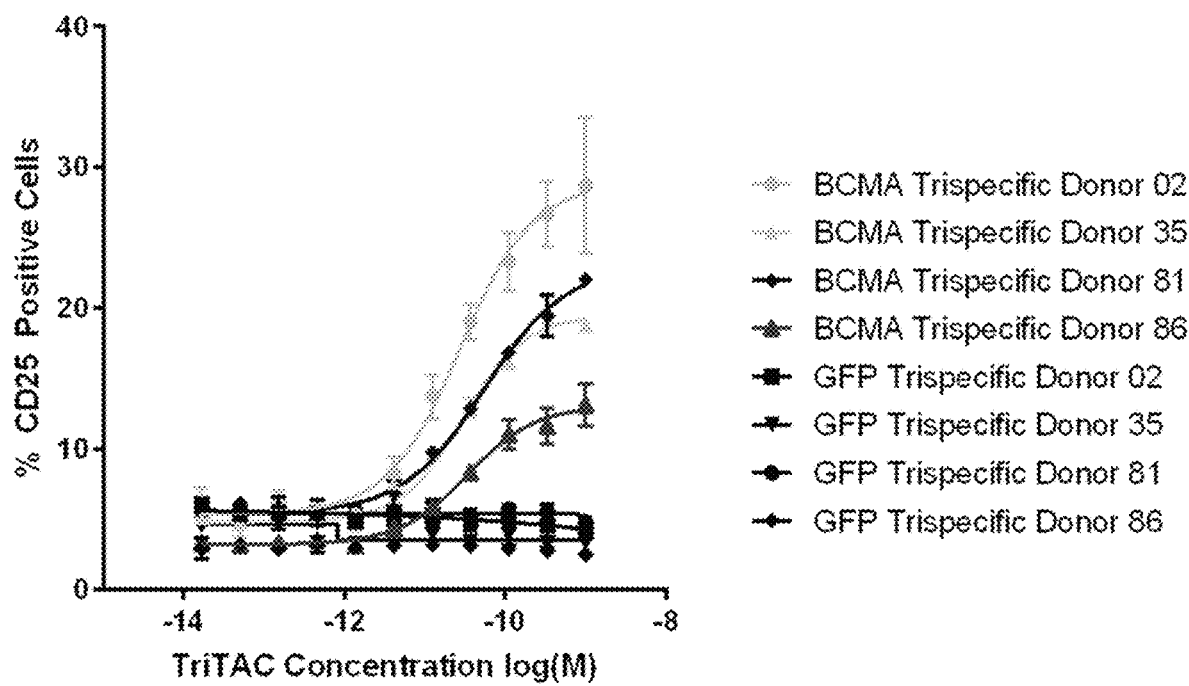
FIG. 20 illustrates the expression level of T cell activation biomarker CD25, following a TDCC assay using an exemplary BCMA targeting trispecific protein (02B05) and BCMA expressing cells EJM.
Figure 21:
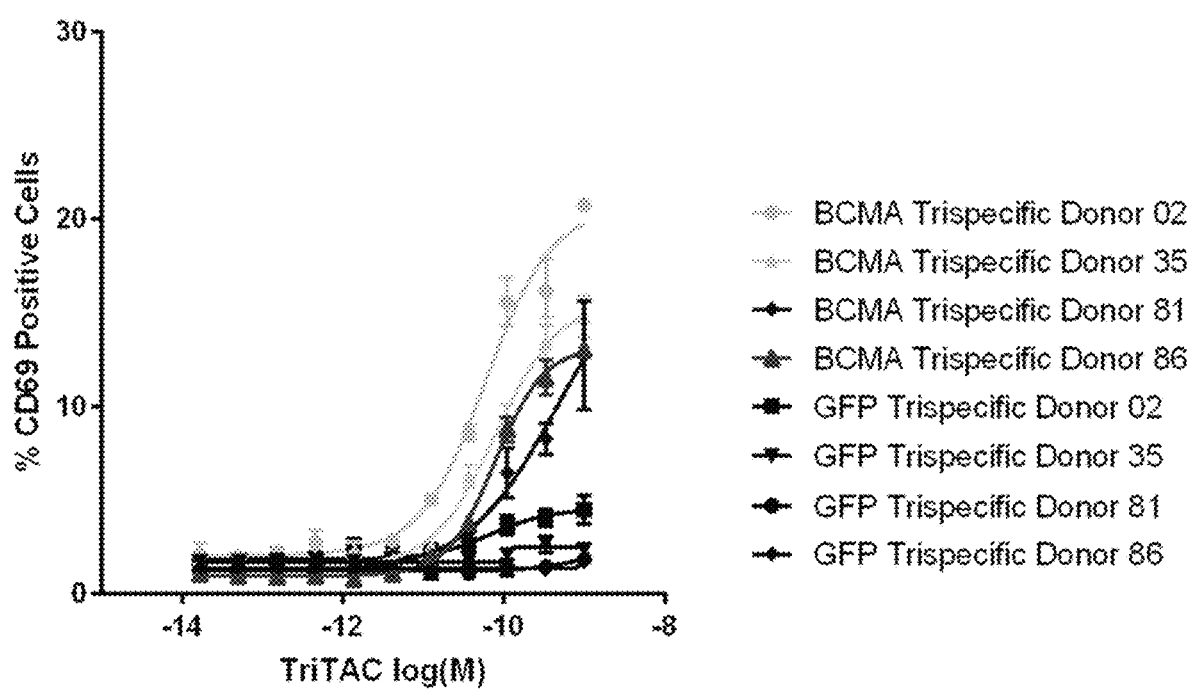
FIG. 21 illustrates the expression level of T cell activation biomarker CD69, following a TDCC assay using an exemplary BCMA targeting trispecific protein (02B05) and BCMA expressing cells OPM2.
Figure 22:
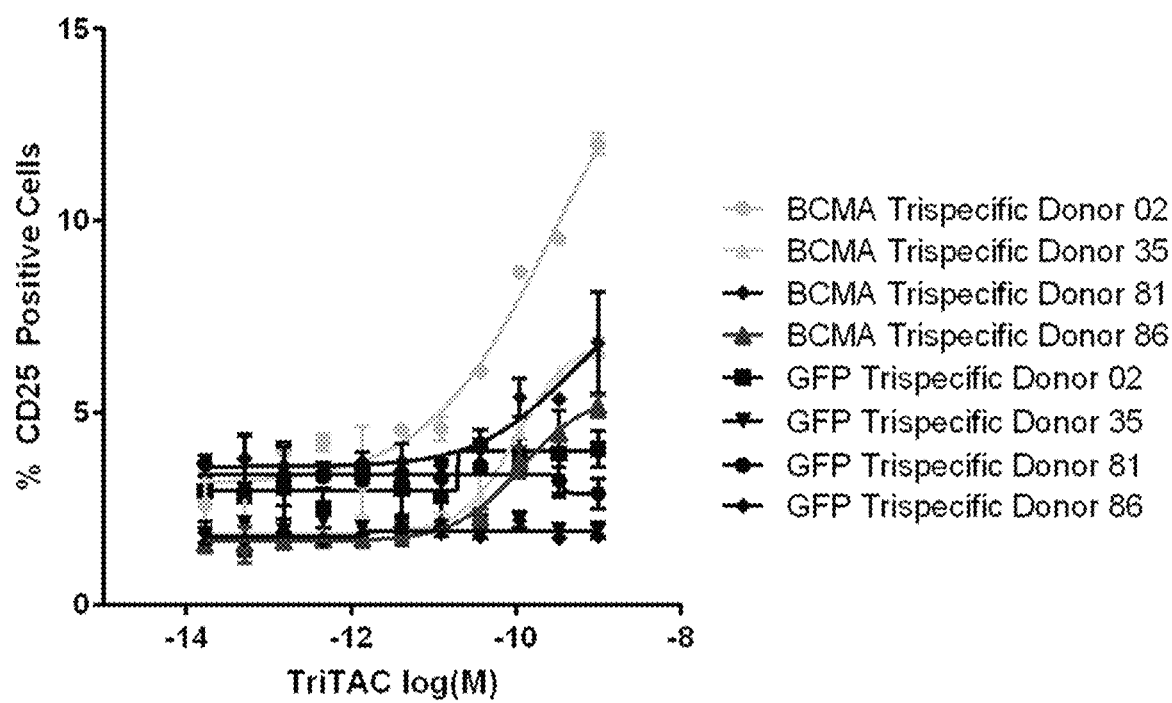
FIG. 22 illustrates the expression level of T cell activation biomarker CD25, following a TDCC assay using an exemplary BCMA targeting trispecific protein (02B05) and BCMA expressing cells OPM2.
Figure 23:
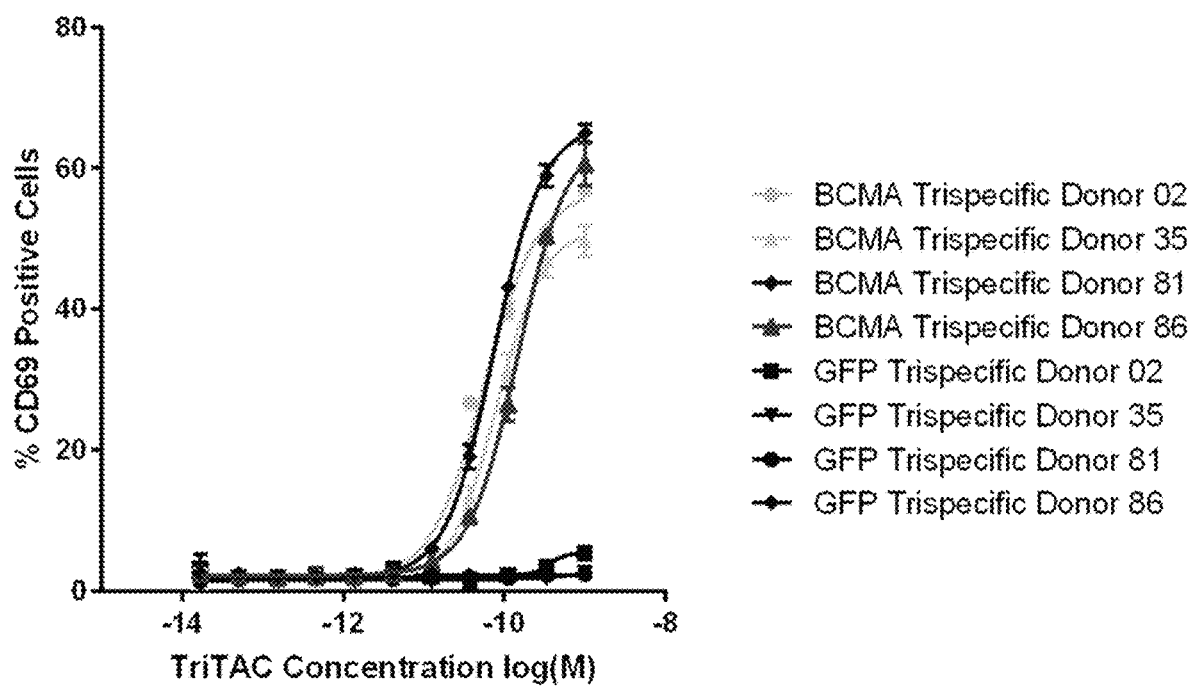
FIG. 23 illustrates the expression level of T cell activation biomarker CD69, following a TDCC assay using an exemplary BCMA targeting trispecific protein (02B05) and BCMA expressing cells RPMI8226.
Figure 24:
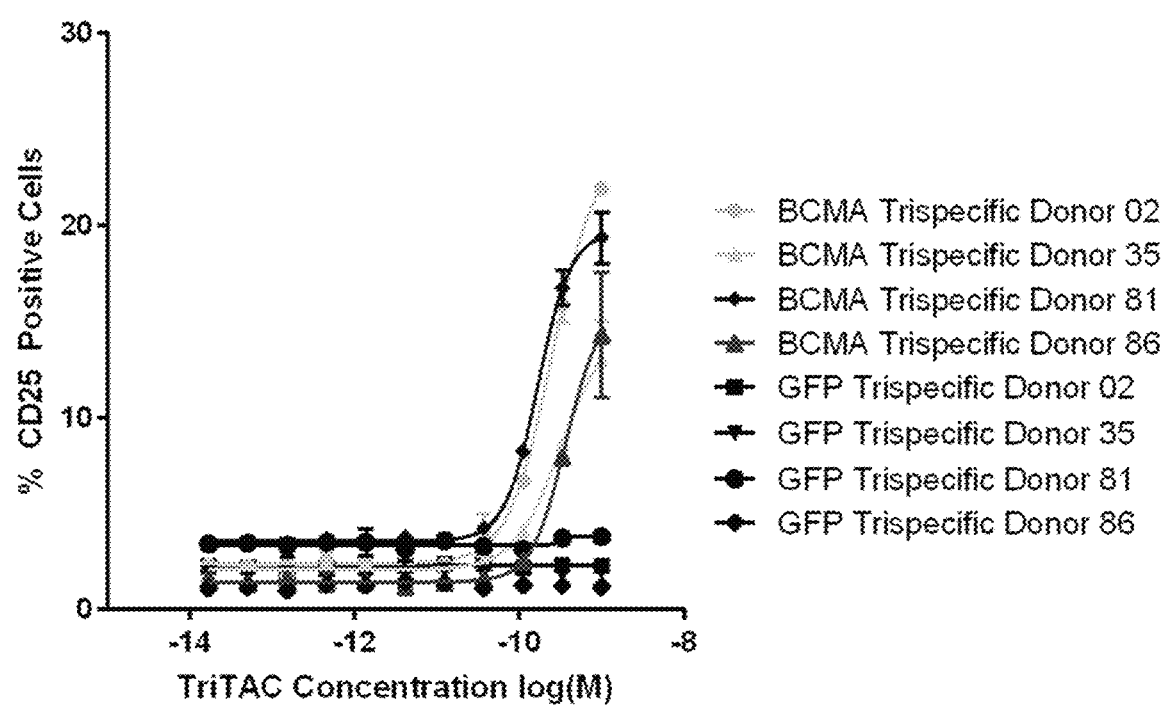
FIG. 24 illustrates the expression level of T cell activation biomarker CD25, following a TDCC assay using an exemplary BCMA targeting trispecific protein (02B05) and BCMA expressing cells RPMI8226.
Figure 25:
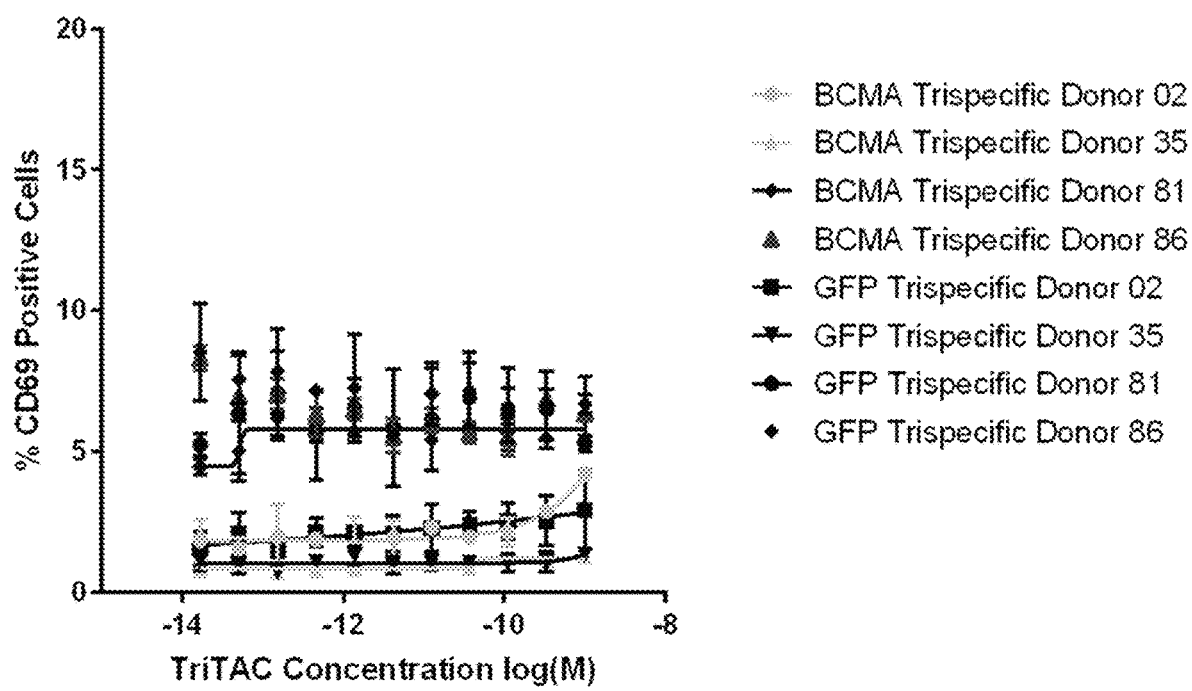
FIG. 25 illustrates the expression level of T cell activation biomarker CD69, following a TDCC assay using an exemplary BCMA targeting trispecific protein (02B05) and BCMA non-expressing cells OVCAR8.
Figure 26:
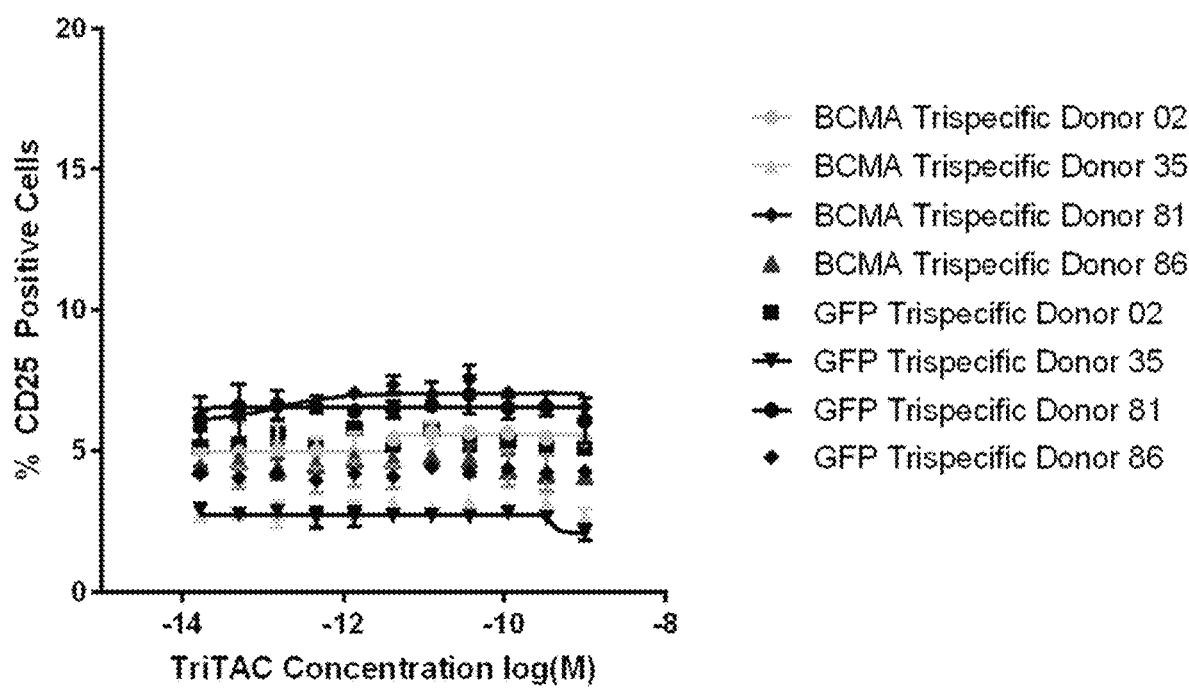
FIG. 26 illustrates the expression level of T cell activation biomarker CD25, following a TDCC assay using an exemplary BCMA targeting trispecific protein (02B05) and BCMA non-expressing cells OVCAR8.
Figure 27:
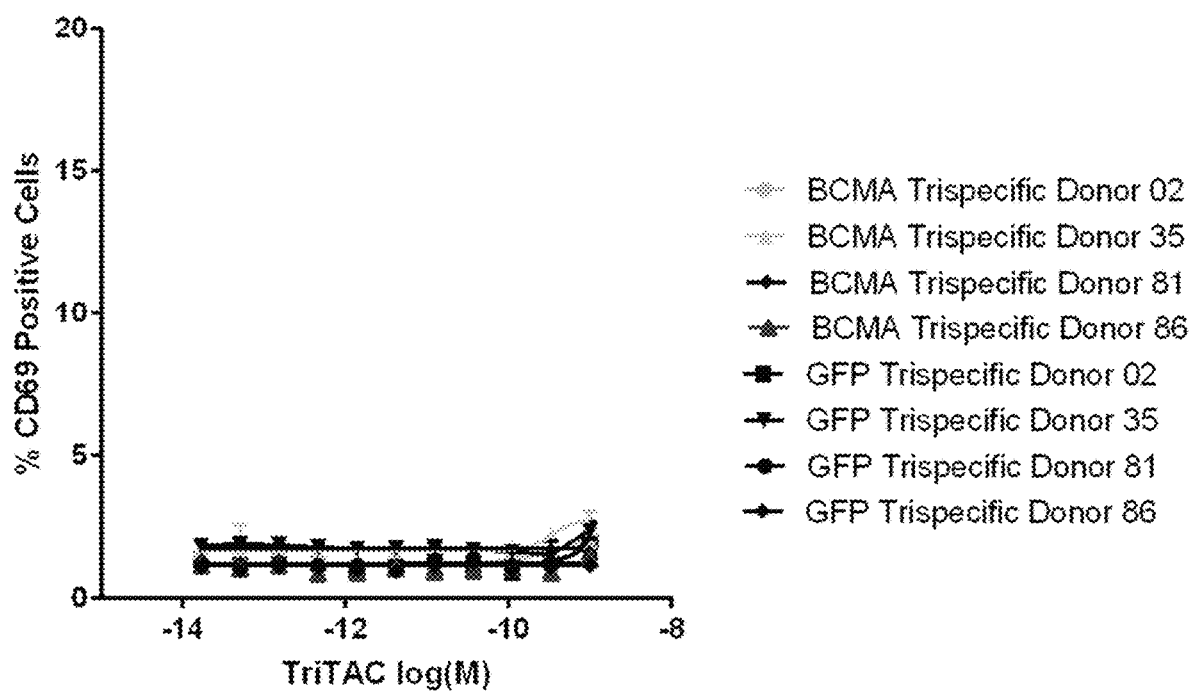
FIG. 27 illustrates the expression level of T cell activation biomarker CD69, following a TDCC assay using an exemplary BCMA targeting trispecific protein (02B05) and BCMA non-expressing cells NCI-H510A.
Figure 28:
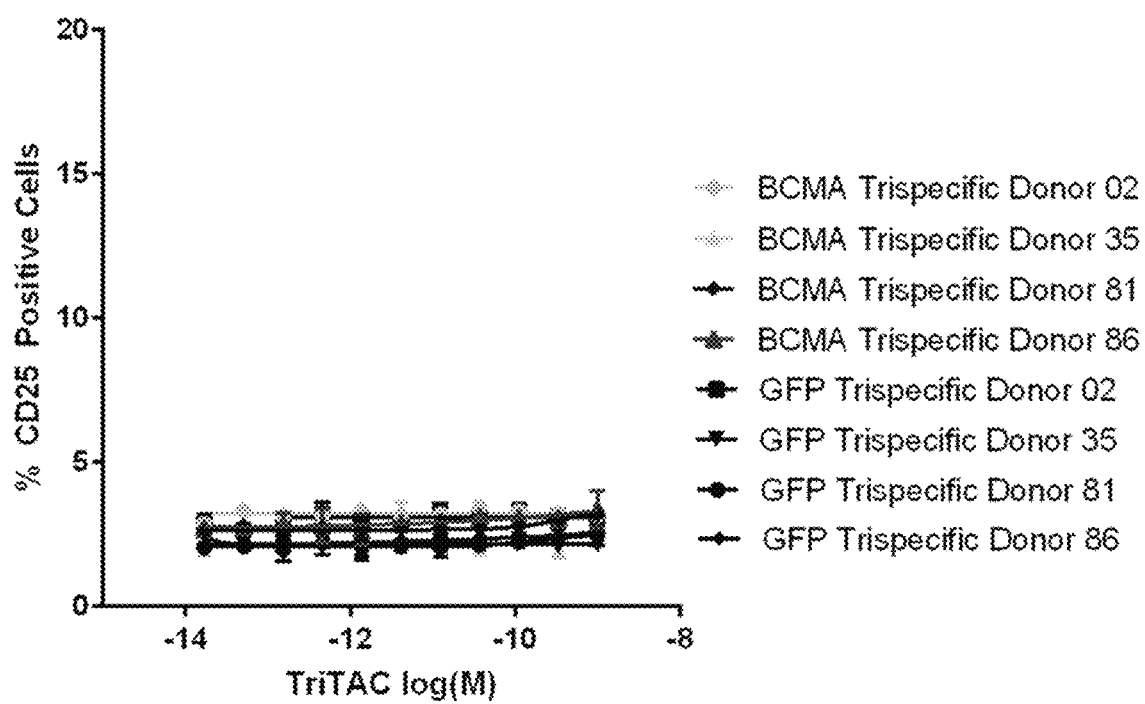
FIG. 28 illustrates the expression level of T cell activation biomarker CD25, following a TDCC assay using an exemplary BCMA targeting trispecific protein (02B05) and BCMA non-expressing cells NCI-H510A.

Ability of an Exemplary BCMA Targeting Trispecific Protein to Direct Cynomolgus T Cells to Kill BCMA Expressing Cells Exemplary BCMA targeting trispecific protein 02B05 (SEQ ID NO: 520) was tested for its ability to direct T cells from cynomolgus monkeys to kill BCMA expressing cells in the presence of 15 mg/ml human serum albumin (HSA). The experimental conditions were the same as described in Example 1 except peripheral blood mononuclear cells (PBMC) from cynomolgus monkeys were used as a source of T cells. Two BCMA expressing cell lines were tested, RPMI8226 and NCI-H929. As shown in FIGS. 17 and 18, the BCMA trispecific protein was able to direct T cells present in the cynomolgus PBMCs to kill the two BCMA expressing cell lines. The $EC_{50}$ values for the cell killing are listed in Table 9. A GFP trispecific protein did not affect viability of the BCMA expressing cells. Thus, the BCMA expressing trispecific protein, which can bind cynomolgus CD3ε (as shown in Example 5), can direct cynomolgus T cells to kill cells expressing human BCMA.

TABLE 9

BCMA trispecific protein $EC_{50}$ values from TDCC Assays with two cell lines and two cynomolgusy PMBC donors in the presence of 15 mg/ml HSA

| | $EC_{50}$ (pM) | |
|---|---|---|
| | RPMI8226 | NCI-H929 |
| Donor G322 | 3654 | 1258 |
| Donor GA33 | 1003 | 288 |

Example 13

Figure 29:
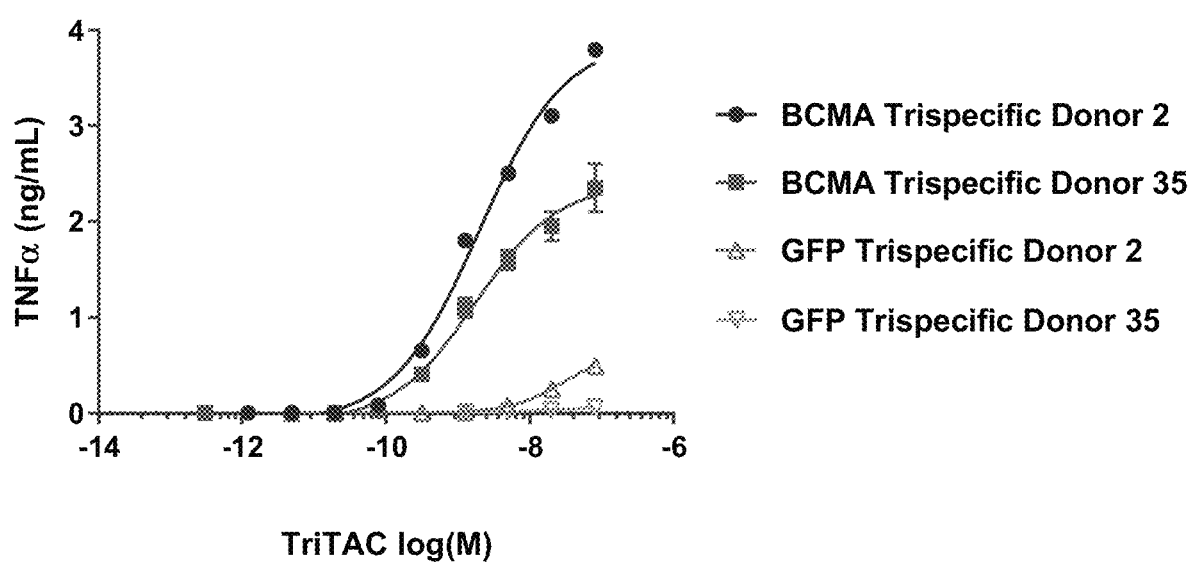
FIG. 29 illustrates the expression level a cytokine, TNF-α, in co-cultures of T cells and BCMA expressing target cells (EJM cells) treated with increasing concentrations of an exemplary BCMA targeting trispecific (02B05) protein or with a negative control GFP trispecific protein.

Exemplary BCMA Trispecifc Antigen-Binding Protein and Target Tumor Cell-Mediated Induction of T cell activation Exemplary BCMA targeting trispecific protein 02B05 (SEQ ID NO: 520) was tested for its ability to activate T cells in the presence of BCMA expressing cells. The BCMA expressing cell lines were EJM, OPM2, and RPMI8226. As negative controls, two cells lines that lack BCMA expression were also included, OVCAR8 and NCI-H510A. T cells were obtained from four different anonymous human donors. The assays were set up using the conditions of a standard TDCC assay as described in Example 1 except the assay was adapted to 96 well format and the assay was carried out in the presence of 15 mg/ml HSA. After the 48 hour assay, T cell activation was assessed by using flow cytometry to measure expression of T cell activation biomarkers CD25 and CD69 on the surface of the T cells. With increasing concentrations of the exemplary 02B05 BCMA trispecific antigen-binding protein increased expression of CD69 and CD25 was observed on T cells when co-cultured with the BCMA expressing cells (as shown in FIGS. 19-24). Thus, the observed increased expression was dependent on interaction of the BCMA binding sequence within the exemplary 02B05 BCMA trispecific antigen-binding protein with BCMA, as little to no activation was observed with a control GFP trispecific protein (as shown in FIGS. 19-24) or with target cells with no BCMA expression (as shown in FIGS. 25-28). Therefore the exemplary 02B05 BCMA trispecific antigen-binding protein activated T cells in co-cultures containing BCMA expressing cells. This conclusion is bolstered by additional data. For instance, expression of a cytokine, TNFα, was measured in the medium collected from a co-culture of T cells and BCMA expressing target cells treated with increasing concentrations of the exemplary 02B05 BCMA trispecific antigen-binding protein or with the negative control GFP trispecific protein. The co-cultures were set up using the conditions of a standard TDCC assay (as described in Example 1) supplemented with 15 mg/ml HSA. TNFα was measured using an electrochemiluminescent assay (Meso Scale Discovery). Robust induction of TNFα expression was observed with the 02B05 exemplary BCMA targeting trispecific protein and not the GFP trispecific protein (FIG. 29). This result further supports that the 02B05 exemplary BCMA targeting trispecific protein activated T cells in co-cultures containing BCMA expressing cells.

Example 14

Figure 32:
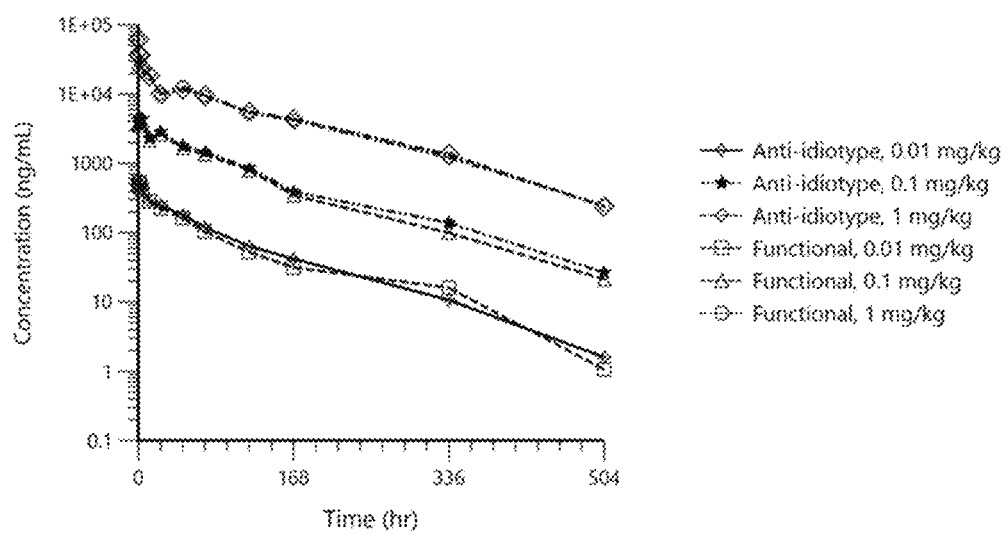
FIG. 32 illustrates concentration of BCMA targeting trispecific protein in serum samples from cynomolgus monkeys dosed with varying concentrations of an exemplary BCMA targeting trispecific (02B05) protein.

Pharmacokinetics of an Exemplary BCMA Targeting Trispecific Protein of this Disclosure Cynomolgus monkeys were administered single intravenous doses of an exemplary BCMA targeting trispecific protein (02B05) (SEQ ID NO: 520), at 0.01 mg/kg, 0.1 mg/kg, or 1 mg/kg. Two animals were included per dose group. Following the administration, serum samples were collected and analyzed by two different electrochemiluminescent assays. One assay used biotinylated CD3ε as a capture reagent and detected with sulfo tagged BCMA (termed the functional assay). Another assay used as a capture reagent a biotinylated antibody recognizing the anti-albumin domain in the exemplary BCMA targeting trispecific protein and used as a detection reagent a sulfo tagged antibody recognizing the anti-CD3 binding domain in the exemplary BCMA targeting trispecific protein (i.e., an anti-idiotype antibody). The results from the electrochemiluminescent assays are plotted in FIG. 32. As seen in FIG. 32, the exemplary BCMA targeting trispecific protein was detected in the cynomolgus serum samples, even after 504 hours after the administration. The exemplary BCMA targeting trispecific protein was identified using both the sulfo-tagged BCMA (lines labeled using the term "functional" in FIG. 32) and by the anti-idiotype antibody (lines labeled using the term "anti-idiotype" in FIG. 32).

Figure 33:
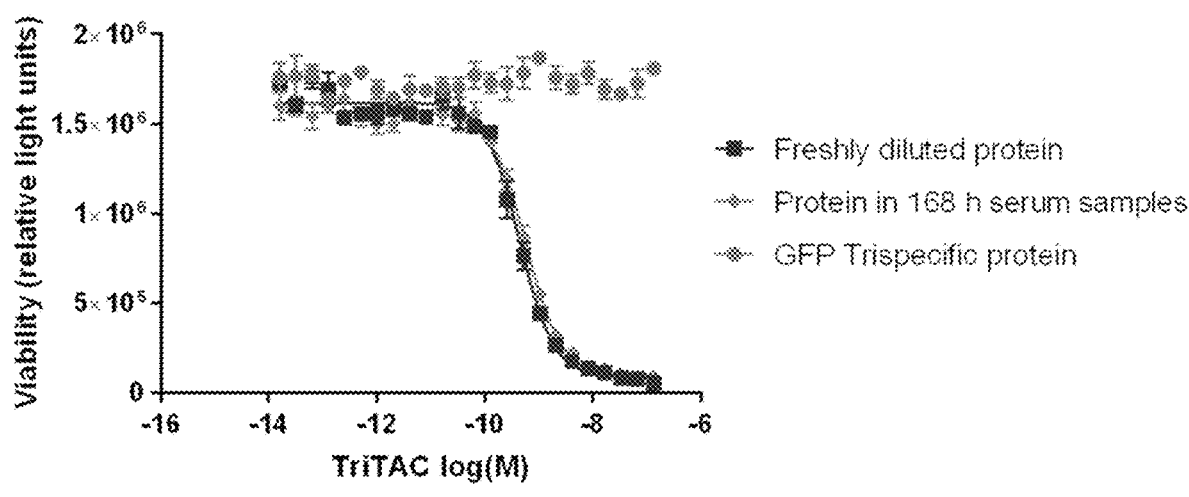
FIG. 33 the results of a TDCC assay using BCMA trispecific targeting protein obtained from serum samples of cynomolgus monkeys collected 168 hours after dosing with varying concentrations of an exemplary BCMA targeting trispecific (02B05) protein, BCMA expressing EJM cells and purified human T cells, in presence of serum from cynomolgus monkeys that were not exposed to a BCMA targeting trispecific protein.

To confirm that the exemplary BCMA targeting trispecific protein retained the ability to direct T cells to kill BCMA expressing EJM cells, after in vivo administration, serum samples from the 168 hour time point were tested in a TDCC assay (as described in Example 1) in the presence of 16.7% serum from a cynomolgus monkey that has not been exposed to a BCMA targeting trispecific protein, titrating the exemplary BCMA targeting trispecific protein using the protein concentrations determined using the electrochemiluminescent assays (shown in FIG. 33). Fresh diluted exemplary 02B05 BCMA trispecific protein was compared to the BCMA trispecific protein collected from the test cynomolgus monkeys at 168 h. A GFP trispecific protein was included as a negative control. This study demonstrated that the exemplary BCMA targeting trispecific protein collected from the test cynomolgus monkeys' serum had identical activity as freshly diluted protein, and that the protein in the serum samples retained the ability to direct T cells to kill BCMA expressing target cells.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

Sequence Table

| SEQ ID NO: | Description | Sequence |
|---|---|---|
| 1. | Exemplary CDR1 | $X_1X_2X_3X_4X_5X_6X_7PX_8G$ where $X_1$ is T or S; $X_2$ is N, D, or S; $X_3$ is I, D, Q, H, V, or E; $X_4$ is F, S, E, A, T, M, V, I, D, Q, P, R, or G; $X_5$ is S, M, R, or N; $X_6$ is I, K, S, T, R, E, D, N, V, H, L, A, Q, or G; $X_7$ is S, T, Y, R, or N; and $X_8$ is M, G, or Y |
| 2. | Exemplary CDR2 | $AIX_9GX_{10}X_{11}TX_{12}YADSVK$ where $X_9$ is H, N, or S; $X_{10}$ is F, G, K, R, P, D, Q, H, E, N, T, S, A, I, L, or V; $X_{11}$ is S, Q, E, T, K, or D; and $X_{12}$ is L, V, I, F, Y, or W |
| 3. | Exemplary CDR3 | $VPWGX_{13}YHPX_{14}X_{15}VX_{16}$ where $X_{13}$ is D, I, T, K, R, A, E, S, or Y; $X_{14}$ is R, G, L, K, T, Q, S, or N; $X_{15}$ is N, K, E, V, R, M, or D; and $X_{16}$ is Y, A, V, K, H, L, M, T, R, Q, C, S, or N |

| SEQ ID NO: | Name | HCDR1 |
|---|---|---|
| 4. | 01A01 | TDIFSISPMG |
| 5. | 01A02 | TNIFSSSPMG |
| 6. | 01A03 | TNIFSISPGG |
| 7. | 01A04 | TNIFMISPMG |
| 8. | 01A05 | TNIFSSSPMG |
| 9. | 01A06 | TNIFSIRPMG |
| 10. | 01A07 | TNISSISPMG |
| 11. | 01A08 | TNIFSSSPMG |
| 12. | 01A09 | TNIFSITPMG |
| 13. | 01B01 | TNIPSISPMG |
| 14. | 01B02 | TNITSISPMG |
| 15. | 01B03 | TNIFSKSPMG |

-continued

| | | Sequence Table |
|---|---|---|
| 16. | 01B04 | TNDFSISPMG |
| 17. | 01B05 | TNITSISPMG |
| 18. | 01B06 | TNIFSISPMG |
| 19. | 01B07 | TNIFSRSPMG |
| 20. | 01B08 | TNIESISPMG |
| 21. | 01B09 | SNIFSISPMG |
| 22. | 01B12 | TNIFSTSPMG |
| 23. | 01C01 | TNIVSISPMG |
| 24. | 01C02 | TNIESISPMG |
| 25. | 01C04 | TNIPSISPMG |
| 26. | 01C05 | TNIFSSSPMG |
| 27. | 01C06 | TNIFSISPMG |
| 28. | 01C07 | TNIFSIYPMG |
| 29. | 01C08 | TNIFSNSPMG |
| 30. | 01C10 | TNISSISPMG |
| 31. | 01D02 | TNIVSISPMG |
| 32. | 01D03 | TNIFSNSPMG |
| 33. | 01D04 | TNITSISPMG |
| 34. | 01D05 | TNIFSDSPMG |
| 35. | 01D06 | TNIFSRSPMG |
| 36. | 01D07 | TNIFSASPMG |
| 37. | 01D10 | TNIFSASPMG |
| 38. | 01E03 | TNITSISPMG |
| 39. | 01E04 | TNIASISPMG |
| 40. | 01E05 | TNIFSRSPMG |
| 41. | 01E06 | TNIFSLSPMG |
| 42. | 01E07 | TNIPSISPMG |
| 43. | 01E08 | TNIFSQSPMG |
| 44. | 01E10 | TNIESISPMG |
| 45. | 01F02 | TNIFSHSPMG |
| 46. | 01F03 | TNIFSESPMG |
| 47. | 01F04 | TNIDSISPMG |
| 48. | 01F05 | TNIFSSSPMG |
| 49. | 01F07 | TNIFSTSPMG |
| 50. | 01F08 | TNITSVSPMG |
| 51. | 01F09 | TNISSISPMG |
| 52. | 01F10 | SNIFSISPMG |
| 53. | 01F12 | TNIFRISPMG |
| 54. | 01G01 | TNIVSISPMG |

-continued

Sequence Table

| | | |
|---|---|---|
| 55. | 01G04 | TNIDSISPMG |
| 56. | 01G06 | TNIFSRSPMG |
| 57. | 01G08 | TNIQSISPMG |
| 58. | 01G09 | TNIFNISPMG |
| 59. | 01G10 | TNEFSISPMG |
| 60. | 01G11 | TNIPSISPMG |
| 61. | 01H01 | TNIGSISPMG |
| 62. | 01H04 | TNIFSKSPMG |
| 63. | 01H05 | TNIFSITPMG |
| 64. | 01H06 | TSDFSISPMG |
| 65. | 01H08 | TNIMSISPMG |
| 66. | 01H09 | TNIMSISPMG |
| 67. | 01H10 | TNIPSISPMG |
| 68. | 01H11 | TNIFSTSPMG |
| 69. | 02A04 | TNIFSQSPMG |
| 70. | 02A05 | TNIASISPMG |
| 71. | 02A07 | TNIFSKSPMG |
| 72. | 02A08 | TNIFSRSPMG |
| 73. | 02A11 | TNHFSISPMG |
| 74. | 02B01 | TNIFSNSPMG |
| 75. | 02B04 | TNIFSTSPMG |
| 76. | 02B05 | TNIFSISPYG |
| 77. | 02B06 | TNIFSNSPMG |
| 78. | 02B07 | TNIFSSSPMG |
| 79. | 02B11 | TNIVSISPMG |
| 80. | 02B12 | TNISSISPMG |
| 81. | 02C01 | TNIISISPMG |
| 82. | 02C03 | TNIASISPMG |
| 83. | 02C05 | TNIFSESPMG |
| 84. | 02C06 | TNIFSTSPMG |
| 85. | 02D06 | TNISSISPMG |
| 86. | 02D09 | TNVVSISPMG |
| 87. | 02D11 | TNEFSISPMG |
| 88. | 02E03 | TNIFSNSPMG |
| 89. | 02E05 | TNIFSRSPMG |
| 90. | 02E06 | TNIFSDSPMG |
| 91. | 02E09 | TNDFSISPMG |
| 92. | 02F02 | TNIFSKSPMG |

Sequence Table -continued

| # | Name | CDR |
|---|---|---|
| 93. | 02F03 | TNIFSIYPMG |
| 94. | 02F04 | TNIFSSSPMG |
| 95. | 02F05 | TNIFSVSPMG |
| 96. | 02F06 | TNIFSITPMG |
| 97. | 02F07 | TNIESISPMG |
| 98. | 02F11 | TNIFSTSPMG |
| 99. | 02F12 | TNIESISPMG |
| 100. | 02G01 | TNIFSINPMG |
| 101. | 02G02 | TNIFSITPMG |
| 102. | 02G05 | TNITSISPMG |
| 103. | 02G06 | TNIFSGSPMG |
| 104. | 02G07 | TNIFSITPMG |
| 105. | 02G08 | TNIDSISPMG |
| 106. | 02G09 | TNIFSDSPMG |
| 107. | 02G11 | TNIDSISPMG |
| 108. | 02H01 | TNIFSKSPMG |
| 109. | 02H04 | TNIFSVSPMG |
| 110. | 02H05 | TNQFSISPMG |
| 111. | 02H06 | TNIRSISPMG |
| 112. | 02H09 | TNIFSRSPMG |
| 113. | 02H11 | TNITSISPMG |
| 114. | 01F07-M34Y | TNIFSTSPYG |
| 115. | 01F01-M34G | TNIFSTSPGG |
| 116. | 02G02-M34Y | TNIFSITPYG |
| 117. | 02G02-M34G | TNIFSITPGG |

| # | Name | CDR2 |
|---|---|---|
| 118. | 01A01 | AIHGGSTLYADSVK |
| 119. | 01A02 | AINGFSTLYADSVK |
| 120. | 01A03 | AIHGSSTLYADSVK |
| 121. | 01A04 | AIHGDSTLYADSVK |
| 122. | 01A05 | AIHGFSTLYADSVK |
| 123. | 01A06 | AIHGFSTVYADSVK |
| 124. | 01A07 | AIHGTSTLYADSVK |
| 125. | 01A08 | AIHGESTLYADSVK |
| 126. | 01A09 | AIHGRSTLYADSVK |
| 127. | 01B01 | AIHGESTLYADSVK |
| 128. | 01B02 | AISGFSTLYADSVK |
| 129. | 01B03 | AIHGKSTLYADSVK |
| 130. | 01B04 | AIHGKSTLYADSVK |

-continued

| | | Sequence Table |
|---|---|---|
| 131. | 01B05 | AIHGFETLYADSVK |
| 132. | 01B06 | AIHGDSTLYADSVK |
| 133. | 01B07 | AIHGNSTLYADSVK |
| 134. | 01B08 | AIHGSSTLYADSVK |
| 135. | 01B09 | AIHGSSTLYADSVK |
| 136. | 01B12 | AIHGFQTLYADSVK |
| 137. | 01C01 | AIHGHSTLYADSVK |
| 138. | 01C02 | AIHGNSTLYADSVK |
| 139. | 01C04 | AIHGDSTLYADSVK |
| 140. | 01C05 | AIHGFKTLYADSVK |
| 141. | 01C06 | AIHGDSTLYADSVK |
| 142. | 01C07 | AIHGFSTYYADSVK |
| 143. | 01C08 | AIHGGSTLYADSVK |
| 144. | 01C10 | AIHGFSTLYADSVK |
| 145. | 01D02 | AIHGKSTLYADSVK |
| 146. | 01D03 | AIHGDSTLYADSVK |
| 147. | 01D04 | AIHGVSTLYADSVK |
| 148. | 01D05 | AIHGTSTLYADSVK |
| 149. | 01D06 | AIHGDSTLYADSVK |
| 150. | 01D07 | AIHGSSTLYADSVK |
| 151. | 01D10 | AIHGSSTLYADSVK |
| 152. | 01E03 | AIHGDSTLYADSVK |
| 153. | 01E04 | AIHGTSTLYADSVK |
| 154. | 01E05 | AIHGTSTLYADSVK |
| 155. | 01E06 | AIHGDSTLYADSVK |
| 156. | 01E07 | AIHGQSTLYADSVK |
| 157. | 01E08 | AIHGDSTLYADSVK |
| 158. | 01E10 | AIHGKSTLYADSVK |
| 159. | 01F02 | AIHGTSTLYADSVK |
| 160. | 01F03 | AIHGNSTLYADSVK |
| 161. | 01F04 | AIHGFQTLYADSVK |
| 162. | 01F05 | AIHGFSTWYADSVK |
| 163. | 01F07 | AIHGFSTIYADSVK |
| 164. | 01F08 | AIHGPSTLYADSVK |
| 165. | 01F09 | AIHGHSTLYADSVK |
| 166. | 01F10 | AIHGESTLYADSVK |
| 167. | 01F12 | AIHGDSTLYADSVK |
| 168. | 01G01 | AIHGDSTLYADSVK |

-continued

| | | Sequence Table |
|---|---|---|
| 169. | 01G04 | AIHGNSTLYADSVK |
| 170. | 01G06 | AIHGFETLYADSVK |
| 171. | 01G08 | AIHGFETLYADSVK |
| 172. | 01G09 | AIHGFSTYYADSVK |
| 173. | 01G10 | AIHGLSTLYADSVK |
| 174. | 01G11 | AIHGASTLYADSVK |
| 175. | 01H01 | AIHGQSTLYADSVK |
| 176. | 01H04 | AIHGQSTLYADSVK |
| 177. | 01H05 | AIHGTSTLYADSVK |
| 178. | 01H06 | AIHGFETLYADSVK |
| 179. | 01H08 | AIHGFSTVYADSVK |
| 180. | 01H09 | AIHGNSTLYADSVK |
| 181. | 01H10 | AIHGESTLYADSVK |
| 182. | 01H11 | AIHGFSTLYADSVK |
| 183. | 02A04 | AIHGKSTLYADSVK |
| 184. | 02A05 | AIHGKSTLYADSVK |
| 185. | 02A07 | AIHGNSTLYADSVK |
| 186. | 02A08 | AIHGESTLYADSVK |
| 187. | 02A11 | AIHGSSTLYADSVK |
| 188. | 02B01 | AIHGRSTLYADSVK |
| 189. | 02B04 | AIHGFSTIYADSVK |
| 190. | 02B05 | AIHGTSTLYADSVK |
| 191. | 02B06 | AIHGFSTLYADSVK |
| 192. | 02B07 | AIHGHSTLYADSVK |
| 193. | 02B11 | AIHGDSTLYADSVK |
| 194. | 02B12 | AIHGFDTLYADSVK |
| 195. | 02C01 | AIHGASTLYADSVK |
| 196. | 02C03 | AIHGSSTLYADSVK |
| 197. | 02C05 | AIHGFTTLYADSVK |
| 198. | 02C06 | AIHGTSTLYADSVK |
| 199. | 02D06 | AIHGFSTVYADSVK |
| 200. | 02D09 | AIHGKSTLYADSVK |
| 201. | 02D11 | AIHGESTLYADSVK |
| 202. | 02E03 | AIHGPSTLYADSVK |
| 203. | 02E05 | AIHGISTLYADSVK |
| 204. | 02E06 | AIHGFSTFYADSVK |
| 205. | 02E09 | AIHGGSTLYADSVK |
| 206. | 02F02 | AIHGSSTLYADSVK |
| 207. | 02F03 | AIHGSSTLYADSVK |

-continued

| | | Sequence Table |
|---|---|---|
| 208. | 02F04 | AIHGFSTLYADSVK |
| 209. | 02F05 | AIHGNSTLYADSVK |
| 210. | 02F06 | AIHGESTLYADSVK |
| 211. | 02F07 | AIHGFSTLYADSVK |
| 212. | 02F11 | AIHGTSTLYADSVK |
| 213. | 02F12 | AIHGTSTLYADSVK |
| 214. | 02G01 | AIHGFDTLYADSVK |
| 215. | 02G02 | AIHGASTLYADSVK |
| 216. | 02G05 | AIHGNSTLYADSVK |
| 217. | 02G06 | AIHGNSTLYADSVK |
| 218. | 02G07 | AIHGESTLYADSVK |
| 219. | 02G08 | AIHGESTLYADSVK |
| 220. | 02G09 | AIHGFSTLYADSVK |
| 221. | 02G11 | AIHGSSTLYADSVK |
| 222. | 02H01 | AIHGSSTLYADSVK |
| 223. | 02H04 | AIHGNSTLYADSVK |
| 224. | 02H05 | AIHGKSTLYADSVK |
| 225. | 02H06 | AIHGSSTLYADSVK |
| 226. | 02H09 | AIHGSSTLYADSVK |
| 227. | 02H11 | AIHGESTLYADSVK |
| 228. | 01F07-M34Y | AIHGFSTIYADSVK |
| 229. | 01F01-M34G | AIHGFSTIYADSVK |
| 230. | 02G02-M34Y | AIHGASTLYADSVK |
| 231. | 02G02-M34G | AIHGASTLYADSVK |
| | Name | CDR3 |
| 232. | 01A01 | VPWGDYHPRNVA |
| 233. | 01A02 | VPWGDYHPRNVH |
| 234. | 01A03 | VPWGDYHPRNVY |
| 235. | 01A04 | VPWGRYHPRNVY |
| 236. | 01A05 | VPWGDYHPRNVY |
| 237. | 01A06 | VPWGDYHPRNVY |
| 238. | 01A07 | VPWGDYHPGNVY |
| 239. | 01A08 | VPWGDYHPRKVY |
| 240. | 01A09 | VPWGSYHPRNVY |
| 241. | 01B01 | VPWGDYHPRNVA |
| 242. | 01B02 | VPWGDYHPRNVY |
| 243. | 01B03 | VPWGDYHPRNVV |
| 244. | 01B04 | VPWGDYHPRNVK |

-continued

Sequence Table

| | | |
|---|---|---|
| 245. | 01B05 | VPWGDYHPGNVY |
| 246. | 01B06 | VPWGEYHPRNVY |
| 247. | 01B07 | VPWGIYHPRNVY |
| 248. | 01B08 | VPWGRYHPRNVY |
| 249. | 01B09 | VPWGDYHPGNVY |
| 250. | 01B12 | VPWGDYHPRNVV |
| 251. | 01C01 | VPWGDYHPGNVY |
| 252. | 01C02 | VPWGRYHPRNVY |
| 253. | 01C04 | VPWGDYHPRNVY |
| 254. | 01C05 | VPWGDYHPGNVY |
| 255. | 01C06 | VPWGKYHPRNVY |
| 256. | 01C07 | VPWGSYHPRNVY |
| 257. | 01C08 | VPWGDYHPRNVH |
| 258. | 01C10 | VPWGYYHPRNVY |
| 259. | 01D02 | VPWGDYHPGNVY |
| 260. | 01D03 | VPWGDYHPRNVR |
| 261. | 01D04 | VPWGDYHPRNVQ |
| 262. | 01D05 | VPWGDYHPRNVY |
| 263. | 01D06 | VPWGDYHPRNVT |
| 264. | 01D07 | VPWGDYHPRNVN |
| 265. | 01D10 | VPWGRYHPRNVY |
| 266. | 01E03 | VPWGDYHPGNVY |
| 267. | 01E04 | VPWGDYHPGNVY |
| 268. | 01E05 | VPWGKYHPRNVY |
| 269. | 01E06 | VPWGDYHPRNVY |
| 270. | 01E07 | VPWGDYHPRNVQ |
| 271. | 01E08 | VPWGDYHPGNVC |
| 272. | 01E10 | VPWGDYHPRRVY |
| 273. | 01F02 | VPWGRYHPRNVY |
| 274. | 01F03 | VPWGTYHPRNVY |
| 275. | 01F04 | VPWGDYHPGNVY |
| 276. | 01F05 | VPWGRYHPRNVY |
| 277. | 01F07 | VPWGDYHPGNVY |
| 278. | 01F08 | VPWGDYHPTNVY |
| 279. | 01F09 | VPWGRYHPRNVY |
| 280. | 01F10 | VPWGDYHPRNVT |
| 281. | 01F12 | VPWGRYHPRNVY |
| 282. | 01G01 | VPWGDYHPRRVY |
| 283. | 01G04 | VPWGDYHPRMVY |

-continued

Sequence Table

| | | |
|---|---|---|
| 284. | 01G06 | VPWGDYHPRNVL |
| 285. | 01G08 | VPWGDYHPGNVY |
| 286. | 01G09 | VPWGRYHPRNVY |
| 287. | 01G10 | VPWGAYHPRNVY |
| 288. | 01G11 | VPWGDYHPRNVA |
| 289. | 01H01 | VPWGDYHPQNVY |
| 290. | 01H04 | VPWGDYHPRNVT |
| 291. | 01H05 | VPWGRYHPRNVY |
| 292. | 01H06 | VPWGDYHPGNVY |
| 293. | 01H08 | VPWGDYHPGNVY |
| 294. | 01H09 | VPWGDYHPGNVY |
| 295. | 01H10 | VPWGDYHPRNVY |
| 296. | 01H11 | VPWGDYHPGNVY |
| 297. | 02A04 | VPWGDYHPSNVY |
| 298. | 02A05 | VPWGDYHPGNVY |
| 299. | 02A07 | VPWGDYHPREVY |
| 300. | 02A08 | VPWGRYHPGNVY |
| 301. | 02A11 | VPWGDYHPRVVY |
| 302. | 02B01 | VPWGDYHPRNVM |
| 303. | 02B04 | VPWGDYHPLNVY |
| 304. | 02B05 | VPWGDYHPGNVY |
| 305. | 02B06 | VPWGDYHPGNVY |
| 306. | 02B07 | VPWGDYHPRNVT |
| 307. | 02B11 | VPWGDYHPRNVS |
| 308. | 02B12 | VPWGDYHPRNVY |
| 309. | 02C01 | VPWGDYHPGNVY |
| 310. | 02C03 | VPWGDYHPGNVY |
| 311. | 02C05 | VPWGDYHPRNVT |
| 312. | 02C06 | VPWGDYHPGNVY |
| 313. | 02D06 | VPWGRYHPRNVY |
| 314. | 02D09 | VPWGDYHPNNVY |
| 315. | 02D11 | VPWGDYHPGNVY |
| 316. | 02E03 | VPWGDYHPRNVT |
| 317. | 02E05 | VPWGDYHPGNVY |
| 318. | 02E06 | VPWGDYHPGNVY |
| 319. | 02E09 | VPWGDYHPRNVA |
| 320. | 02F02 | VPWGDYHPGNVY |
| 321. | 02F03 | VPWGDYHPKNVY |

-continued

Sequence Table

| | | |
|---|---|---|
| 322. | 02F04 | VPWGDYHPGNVY |
| 323. | 02F05 | VPWGKYHPRNVY |
| 324. | 02F06 | VPWGRYHPRNVY |
| 325. | 02F07 | VPWGDYHPGNVY |
| 326. | 02F11 | VPWGDYHPRNVQ |
| 327. | 02F12 | VPWGDYHPGNVY |
| 328. | 02G01 | VPWGDYHPRNVS |
| 329. | 02G02 | VPWGDYHPGNVY |
| 330. | 02G05 | VPWGDYHPGNVY |
| 331. | 02G06 | VPWGDYHPGNVY |
| 332. | 02G07 | VPWGDYHPRDVY |
| 333. | 02G08 | VPWGDYHPRNVT |
| 334. | 02G09 | VPWGDYHPRNVA |
| 335. | 02G11 | VPWGDYHPRNVT |
| 336. | 02H01 | VPWGDYHPRNVY |
| 337. | 02H04 | VPWGDYHPRNVY |
| 338. | 02H05 | VPWGDYHPRNVV |
| 339. | 02H06 | VPWGDYHPRNVV |
| 340. | 02H09 | VPWGDYHPGNVY |
| 341. | 02H11 | VPWGDYHPRNVY |
| 342. | 01F07-M34Y | VPWGDYHPGNVY |
| 343. | 01F01-M34G | VPWGDYHPGNVY |
| 344. | 02G02-M34Y | VPWGDYHPGNVY |
| 345. | 02G02-M34G | VPWGDYHPGNVY |

| SEQ ID NO | Construct Name | VHH Sequences |
|---|---|---|
| 346. | BH2T | EVQLVESGGGLVQPGRSLTLSCAASTNIFSISPMGWYRQAPGKQRELVAAIHGFSTLYADSVKGRFTISRDNAKNSIYLQMNSLRPEDTALYYCNKVPWGDYHPRNVYWGQGTQVTVSS |
| 347. | 01A01 | EVQLVESGGGLVQPGRSLTLSCAASTDIFSISPMGWYRQAPGKQRELVAAIHGGSTLYADSVKGRFTISRDNAKNSIYLQMNSLRPEDTALYYCNKVPWGDYHPRNVAWGQGTQVTVSS |
| 348. | 02E09 | EVQLVESGGGLVQPGRSLTLSCAASTNDFSISPMGWYRQAPGKQRELVAAIHGGSTLYADSVKGRFTISRDNAKNSIYLQMNSLRPEDTALYYCNKVPWGDYHPRNVAWGQGTQVTVSS |
| 349. | 01B03 | EVQLVESGGGLVQPGRSLTLSCAASTNIFSKSPMGWYRQAPGKQRELVAAIHGKSTLYADSVKGRFTISRDNAKNSIYLQMNSLRPEDTALYYCNKVPWGDYHPRNVVWGQGTQVTVSS |
| 350. | 01B04 | EVQLVESGGGLVQPGRSLTLSCAASTNDFSISPMGWYRQAPGKQRELVAAIHGKSTLYADSVKGRFTISRDNAKNSIYLQMNSLRPEDTALYYCNKVPWGDYHPRNVKWGQGTQVTVSS |
| 351. | 02H05 | EVQLVESGGGLVQPGRSLTLSCAASTNQFSISPMGWYRQAPGKQRELVAAIHGKSTLYADSVKGRFTISRDNAKNSIYLQMNSLRPEDTALYYCNKVPWGDYHPRNVVWGQGTQVTVSS |

| | | Sequence Table |
|---|---|---|
| 352. | 01A02 | EVQLVESGGGLVQPGRSLTLSCAASTNIFSSSPMGWYRQAPGKQRELVAAING<br>FSTLYADSVKGRFTISRDNAKNSIYLQMNSLRPEDTALYYCNKVPWGDYHPRN<br>VHWGQGTQVTVSS |
| 353. | 01A05 | EVQLVESGGGLVQPGRSLTLSCAASTNIFSSSPMGWYRQAPGKQRELVAAIHG<br>FSTLYADSVKGRFTISRDNAKNSIYLQMNSLRPEDTALYYCNKVPWGDYHPRN<br>VYWGQGTQVTVSS |
| 354. | 01B12 | EVQLVESGGGLVQPGRSLTLSCAASTNIFSTSPMGWYRQAPGKQRELVAAIHG<br>FQTLYADSVKGRFTISRDNAKNSIYLQMNSLRPEDTALYYCNKVPWGDYHPRN<br>VVWGQGTQVTVSS |
| 355. | 01G06 | EVQLVESGGGLVQPGRSLTLSCAASTNIFSRSPMGWYRQAPGKQRELVAAIHG<br>FETLYADSVKGRFTISRDNAKNSIYLQMNSLRPEDTALYYCNKVPWGDYHPRN<br>VLWGQGTQVTVSS |
| 356. | 02C05 | EVQLVESGGGLVQPGRSLTLSCAASTNIFSESPMGWYRQAPGKQRELVAAIHG<br>FTTLYADSVKGRFTISRDNAKNSIYLQMNSLRPEDTALYYCNKVPWGDYHPRN<br>VTWGQGTQVTVSS |
| 357. | 02G09 | EVQLVESGGGLVQPGRSLTLSCAASTNIFSDSPMGWYRQAPGKQRELVAAIHG<br>FSTLYADSVKGRFTISRDNAKNSIYLQMNSLRPEDTALYYCNKVPWGDYHPRN<br>VAWGQGTQVTVSS |
| 358. | 01C08 | EVQLVESGGGLVQPGRSLTLSCAASTNIFSNSPMGWYRQAPGKQRELVAAIHG<br>GSTLYADSVKGRFTISRDNAKNSIYLQMNSLRPEDTALYYCNKVPWGDYHPRN<br>VHWGQGTQVTVSS |
| 359. | 02B01 | EVQLVESGGGLVQPGRSLTLSCAASTNIFSNSPMGWYRQAPGKQRELVAAIHG<br>RSTLYADSVKGRFTISRDNAKNSIYLQMNSLRPEDTALYYCNKVPWGDYHPRN<br>VMWGQGTQVTVSS |
| 360. | 02E03 | EVQLVESGGGLVQPGRSLTLSCAASTNIFSNSPMGWYRQAPGKQRELVAAIHG<br>PSTLYADSVKGRFTISRDNAKNSIYLQMNSLRPEDTALYYCNKVPWGDYHPRN<br>VTWGQGTQVTVSS |
| 361. | 01D03 | EVQLVESGGGLVQPGRSLTLSCAASTNIFSNSPMGWYRQAPGKQRELVAAIHG<br>DSTLYADSVKGRFTISRDNAKNSIYLQMNSLRPEDTALYYCNKVPWGDYHPRN<br>VRWGQGTQVTVSS |
| 362. | 01D06 | EVQLVESGGGLVQPGRSLTLSCAASTNIFSRSPMGWYRQAPGKQRELVAAIHG<br>DSTLYADSVKGRFTISRDNAKNSIYLQMNSLRPEDTALYYCNKVPWGDYHPRN<br>VTWGQGTQVTVSS |
| 363. | 01H04 | EVQLVESGGGLVQPGRSLTLSCAASTNIFSKSPMGWYRQAPGKQRELVAAIHG<br>QSTLYADSVKGRFTISRDNAKNSIYLQMNSLRPEDTALYYCNKVPWGDYHPRN<br>VTWGQGTQVTVSS |
| 364. | 02B07 | EVQLVESGGGLVQPGRSLTLSCAASTNIFSSSPMGWYRQAPGKQRELVAAIHG<br>HSTLYADSVKGRFTISRDNAKNSIYLQMNSLRPEDTALYYCNKVPWGDYHPRN<br>VTWGQGTQVTVSS |
| 365. | 01A08 | EVQLVESGGGLVQPGRSLTLSCAASTNIFSSSPMGWYRQAPGKQRELVAAIHG<br>ESTLYADSVKGRFTISRDNAKNSIYLQMNSLRPEDTALYYCNKVPWGDYHPRK<br>VYWGQGTQVTVSS |
| 366. | 01B07 | EVQLVESGGGLVQPGRSLTLSCAASTNIFSRSPMGWYRQAPGKQRELVAAIHG<br>NSTLYADSVKGRFTISRDNAKNSIYLQMNSLRPEDTALYYCNKVPWGIYHPRN<br>VYWGQGTQVTVSS |
| 367. | 01F03 | EVQLVESGGGLVQPGRSLTLSCAASTNIFSESPMGWYRQAPGKQRELVAAIHG<br>NSTLYADSVKGRFTISRDNAKNSIYLQMNSLRPEDTALYYCNKVPWGTYHPRN<br>VYWGQGTQVTVSS |
| 368. | 02F05 | EVQLVESGGGLVQPGRSLTLSCAASTNIFSVSPMGWYRQAPGKQRELVAAIHG<br>NSTLYADSVKGRFTISRDNAKNSIYLQMNSLRPEDTALYYCNKVPWGKYHPRN<br>VYWGQGTQVTVSS |
| 369. | 02H04 | EVQLVESGGGLVQPGRSLTLSCAASTNIFSVSPMGWYRQAPGKQRELVAAIHG<br>NSTLYADSVKGRFTISRDNAKNSIYLQMNSLRPEDTALYYCNKVPWGDYHPRN<br>VYWGQGTQVTVSS |
| 370. | 02A07 | EVQLVESGGGLVQPGRSLTLSCAASTNIFSKSPMGWYRQAPGKQRELVAAIHG<br>NSTLYADSVKGRFTISRDNAKNSIYLQMNSLRPEDTALYYCNKVPWGDYHPRE<br>VYWGQGTQVTVSS |

| | | Sequence Table |
|---|---|---|
| 371. | 01D05 | EVQLVESGGGLVQPGRSLTLSCAASTNIFSDSPMGWYRQAPGKQRELVAAIHG<br>TSTLYADSVKGRFTISRDNAKNSIYLQMNSLRPEDTALYYCNKVPWGDYHPRN<br>VYWGQGTQVTVSS |
| 372. | 01E05 | EVQLVESGGGLVQPGRSLTLSCAASTNIFSRSPMGWYRQAPGKQRELVAAIHG<br>TSTLYADSVKGRFTISRDNAKNSIYLQMNSLRPEDTALYYCNKVPWGKYHPRN<br>VYWGQGTQVTVSS |
| 373. | 01F02 | EVQLVESGGGLVQPGRSLTLSCAASTNIFSHSPMGWYRQAPGKQRELVAAIHG<br>TSTLYADSVKGRFTISRDNAKNSIYLQMNSLRPEDTALYYCNKVPWGRYHPRN<br>VYWGQGTQVTVSS |
| 374. | 02C06 | EVQLVESGGGLVQPGRSLTLSCAASTNIFSTSPMGWYRQAPGKQRELVAAIHG<br>TSTLYADSVKGRFTISRDNAKNSIYLQMNSLRPEDTALYYCNKVPWGDYHPGN<br>VYWGQGTQVTVSS |
| 375. | 02F11 | EVQLVESGGGLVQPGRSLTLSCAASTNIFSTSPMGWYRQAPGKQRELVAAIHG<br>TSTLYADSVKGRFTISRDNAKNSIYLQMNSLRPEDTALYYCNKVPWGDYHPRN<br>VQWGQGTQVTVSS |
| 376. | 01E06 | EVQLVESGGGLVQPGRSLTLSCAASTNIFSLSPMGWYRQAPGKQRELVAAIHG<br>DSTLYADSVKGRFTISRDNAKNSIYLQMNSLRPEDTALYYCNKVPWGDYHPRN<br>VYWGQGTQVTVSS |
| 377. | 01A03 | EVQLVESGGGLVQPGRSLTLSCAASTNIFSISPGGWYRQAPGKQRELVAAIHG<br>SSTLYADSVKGRFTISRDNAKNSIYLQMNSLRPEDTALYYCNKVPWGDYHPRN<br>VYWGQGTQVTVSS |
| 378. | 02A11 | EVQLVESGGGLVQPGRSLTLSCAASTNHFSISPMGWYRQAPGKQRELVAAIHG<br>SSTLYADSVKGRFTISRDNAKNSIYLQMNSLRPEDTALYYCNKVPWGDYHPRV<br>VYWGQGTQVTVSS |
| 379. | 01D07 | EVQLVESGGGLVQPGRSLTLSCAASTNIFSASPMGWYRQAPGKQRELVAAIHG<br>SSTLYADSVKGRFTISRDNAKNSIYLQMNSLRPEDTALYYCNKVPWGDYHPRN<br>VNWGQGTQVTVSS |
| 380. | 01D10 | EVQLVESGGGLVQPGRSLTLSCAASTNIFSASPMGWYRQAPGKQRELVAAIHG<br>SSTLYADSVKGRFTISRDNAKNSIYLQMNSLRPEDTALYYCNKVPWGRYHPRN<br>VYWGQGTQVTVSS |
| 381. | 01A07 | EVQLVESGGGLVQPGRSLTLSCAASTNISSISPMGWYRQAPGKQRELVAAIHG<br>TSTLYADSVKGRFTISRDNAKNSIYLQMNSLRPEDTALYYCNKVPWGDYHPGN<br>VYWGQGTQVTVSS |
| 382. | 02F12 | EVQLVESGGGLVQPGRSLTLSCAASTNIESISPMGWYRQAPGKQRELVAAIHG<br>TSTLYADSVKGRFTISRDNAKNSIYLQMNSLRPEDTALYYCNKVPWGDYHPGN<br>VYWGQGTQVTVSS |
| 383. | 02B05 | EVQLVESGGGLVQPGRSLTLSCAASTNIFSISPYGWYRQAPGKQRELVAAIHG<br>TSTLYADSVKGRFTISRDNAKNSIYLQMNSLRPEDTALYYCNKVPWGDYHPGN<br>VYWGQGTQVTVSS |
| 384. | 01E04 | EVQLVESGGGLVQPGRSLTLSCAASTNIASISPMGWYRQAPGKQRELVAAIHG<br>TSTLYADSVKGRFTISRDNAKNSIYLQMNSLRPEDTALYYCNKVPWGDYHPGN<br>VYWGQGTQVTVSS |
| 385. | 02A05 | EVQLVESGGGLVQPGRSLTLSCAASTNIASISPMGWYRQAPGKQRELVAAIHG<br>KSTLYADSVKGRFTISRDNAKNSIYLQMNSLRPEDTALYYCNKVPWGDYHPGN<br>VYWGQGTQVTVSS |
| 386. | 02C03 | EVQLVESGGGLVQPGRSLTLSCAASTNIASISPMGWYRQAPGKQRELVAAIHG<br>SSTLYADSVKGRFTISRDNAKNSIYLQMNSLRPEDTALYYCNKVPWGDYHPGN<br>VYWGQGTQVTVSS |
| 387. | 01E03 | EVQLVESGGGLVQPGRSLTLSCAASTNITSISPMGWYRQAPGKQRELVAAIHG<br>DSTLYADSVKGRFTISRDNAKNSIYLQMNSLRPEDTALYYCNKVPWGDYHPGN<br>VYWGQGTQVTVSS |
| 388. | 01H09 | EVQLVESGGGLVQPGRSLTLSCAASTNIMSISPMGWYRQAPGKQRELVAAIHG<br>NSTLYADSVKGRFTISRDNAKNSIYLQMNSLRPEDTALYYCNKVPWGDYHPGN<br>VYWGQGTQVTVSS |
| 389. | 02G05 | EVQLVESGGGLVQPGRSLTLSCAASTNITSISPMGWYRQAPGKQRELVAAIHG<br>NSTLYADSVKGRFTISRDNAKNSIYLQMNSLRPEDTALYYCNKVPWGDYHPGN<br>VYWGQGTQVTVSS |

| | | Sequence Table |
|---|---|---|
| 390. | 01C01 | EVQLVESGGGLVQPGRSLTLSCAASTNIVSISPMGWYRQAPGKQRELVAAIHG<br>HSTLYADSVKGRFTISRDNAKNSIYLQMNSLRPEDTALYYCNKVPWGDYHPGN<br>VYWGQGTQVTVSS |
| 391. | 01D02 | EVQLVESGGGLVQPGRSLTLSCAASTNIVSISPMGWYRQAPGKQRELVAAIHG<br>KSTLYADSVKGRFTISRDNAKNSIYLQMNSLRPEDTALYYCNKVPWGDYHPGN<br>VYWGQGTQVTVSS |
| 392. | 02D09 | EVQLVESGGGLVQPGRSLTLSCAASTNVVSISPMGWYRQAPGKQRELVAAIHG<br>KSTLYADSVKGRFTISRDNAKNSIYLQMNSLRPEDTALYYCNKVPWGDYHPNN<br>VYWGQGTQVTVSS |
| 393. | 02C01 | EVQLVESGGGLVQPGRSLTLSCAASTNIISISPMGWYRQAPGKQRELVAAIHG<br>ASTLYADSVKGRFTISRDNAKNSIYLQMNSLRPEDTALYYCNKVPWGDYHPGN<br>VYWGQGTQVTVSS |
| 394. | 02G02 | EVQLVESGGGLVQPGRSLTLSCAASTNIFSITPMGWYRQAPGKQRELVAAIHG<br>ASTLYADSVKGRFTISRDNAKNSIYLQMNSLRPEDTALYYCNKVPWGDYHPGN<br>VYWGQGTQVTVSS |
| 395. | 01B05 | EVQLVESGGGLVQPGRSLTLSCAASTNITSISPMGWYRQAPGKQRELVAAIHG<br>FETLYADSVKGRFTISRDNAKNSIYLQMNSLRPEDTALYYCNKVPWGDYHPGN<br>VYWGQGTQVTVSS |
| 396. | 01G08 | EVQLVESGGGLVQPGRSLTLSCAASTNIQSISPMGWYRQAPGKQRELVAAIHG<br>FETLYADSVKGRFTISRDNAKNSIYLQMNSLRPEDTALYYCNKVPWGDYHPGN<br>VYWGQGTQVTVSS |
| 397. | 01H06 | EVQLVESGGGLVQPGRSLTLSCAASTSDFSISPMGWYRQAPGKQRELVAAIHG<br>FETLYADSVKGRFTISRDNAKNSIYLQMNSLRPEDTALYYCNKVPWGDYHPGN<br>VYWGQGTQVTVSS |
| 398. | 01F04 | EVQLVESGGGLVQPGRSLTLSCAASTNIDSISPMGWYRQAPGKQRELVAAIHG<br>FQTLYADSVKGRFTISRDNAKNSIYLQMNSLRPEDTALYYCNKVPWGDYHPGN<br>VYWGQGTQVTVSS |
| 399. | 01H08 | EVQLVESGGGLVQPGRSLTLSCAASTNIMSISPMGWYRQAPGKQRELVAAIHG<br>FSTVYADSVKGRFTISRDNAKNSIYLQMNSLRPEDTALYYCNKVPWGDYHPGN<br>VYWGQGTQVTVSS |
| 400. | 02F07 | EVQLVESGGGLVQPGRSLTLSCAASTNIESISPMGWYRQAPGKQRELVAAIHG<br>FSTLYADSVKGRFTISRDNAKNSIYLQMNSLRPEDTALYYCNKVPWGDYHPGN<br>VYWGQGTQVTVSS |
| 401. | 01C05 | EVQLVESGGGLVQPGRSLTLSCAASTNIFSSSPMGWYRQAPGKQRELVAAIHG<br>FKTLYADSVKGRFTISRDNAKNSIYLQMNSLRPEDTARYYCNKVPWGDYHPGN<br>VYWGQGTQVTVSS |
| 402. | 02F04 | EVQLVESGGGLVQPGRSLTLSCAASTNIFSSSPMGWYRQAPGKQRELVAAIHG<br>FSTLYADSVKGRFTISRDNAKNSIYLQMNSLRPEDTALYYCNKVPWGDYHPGN<br>VYWGQGTQVTVSS |
| 403. | 02B06 | EVQLVESGGGLVQPGRSLTLSCAASTNIFSNSPMGWYRQAPGKQRELVAAIHG<br>FSTLYADSVKGRFTISRDNAKNSIYLQMNSLRPEDTALYYCNKVPWGDYHPGN<br>VYWGQGTQVTVSS |
| 404. | 01F07 | EVQLVESGGGLVQPGRSLTLSCAASTNIFSTSPMGWYRQAPGKQRELVAAIHG<br>FSTIYADSVKGRFTISRDNAKNSIYLQMNSLRPEDTALYYCNKVPWGDYHPGN<br>VYWGQGTQVTVSS |
| 405. | 02B04 | EVQLVESGGGLVQPGRSLTLSCAASTNIFSTSPMGWYRQAPGKQRELVAAIHG<br>FSTIYADSVKGRFTISRDNAKNSIYLQMNSLRPEDTALYYCNKVPWGDYHPLN<br>VYWGQGTQVTVSS |
| 406. | 01H11 | EVQLVESGGGLVQPGRSLTLSCVASTNIFSTSPMGWYRQAPGKQRELVAAIHG<br>FSTLYADSVKGRFTISRDNAKNSIYLQMNSLRPEDTALYYCNKVPWGDYHPGN<br>VYWGQGTQVTVSS |
| 407. | 02E06 | EVQLVESGGGLVQPGRSLTLSCAASTNIFSDSPMGWYRQAPGKQRELVAAIHG<br>FSTFYADSVKGRFTISRDNAKNSIYLQMNSLRPEDTALYYCNKVPWGDYHPGN<br>VYWGQGTQVTVSS |
| 408. | 01E08 | EVQLVESGGGLVQPGRSLTLSCAASTNIFSQSPMGWYRQAPGKQRELVAAIHG<br>DSTLYADSVKGRFTISRDNAKNSIYLQMNSLRPEDTALYYCNKVPWGDYHPGN<br>VCWGQGTQVTVSS |

| | | Sequence Table |
|---|---|---|
| 409. | 02A04 | EVQLVESGGGLVQPGRSLTLSCAASTNIFSQSPMGWYRQAPGKQRELVAAIHG KSTLYADSVKGRFTISRDNAKNSIYLQMNSLRPEDTALYYCNKVPWGDYHPSN VYWGKGTQVTVSS |
| 410. | 02A08 | EVQLVESGGGLVQPGRSLTLSCAASTNIFSRSPMGWYRQAPGKQRELVAAIHG ESTLYADSVKGRFTISRDNAKNSIYLQMNSLRPEDTALYYCNKVPWGRYHPGN VYWGQGTQVTVSS |
| 411. | 02E05 | EVQLVESGGGLVQPGRSLTLSCAASTNIFSRSPMGWYRQAPGKQRELVAAIHG ISTLYADSVKGRFTISRDNAKNSIYLQMNSLRPEDTALYYCNKVPWGDYHPGN VYWGQGTQVTVSS |
| 412. | 02H09 | EVQLVESGGGLVQPGRSLTLSCAASTNIFSRSPMGWYRQAPGKQRELVAAIHG SSTLYADSVKGRFTISRDNAKNSIYLQMNSLRPEDTALYYCNKVPWGDYHPGN VYWGQGTQVTVSS |
| 413. | 02G06 | EVQLVESGGGLVQPGRSLTLSCAASTNIFSGSPMGWYRQAPGKQRELVAAIHG NSTLYADSVKGRFTISRDNAKNSIYLQMNSLRPEDTALYYCNKVPWGDYHPGN VYWGQGTQVTVSS |
| 414. | 01B09 | EVQLVESGGGLVQPGRSLTLSCAASSNIFSISPMGWYRQAPGKQRELVAAIHG SSTLYADSVKGRFTISRDNAKNSIYLQMNSLRPEDTALYYCNKVPWGDYHPGN VYWGQGTQVTVSS |
| 415. | 02F03 | EVQLVESGGGLVQPGRSLTLSCAASTNIFSIYPMGWYRQAPGKQRELVAAIHG SSTLYADSVKGRFTISRDNAKNSIYLQMNSLRPEDTALYYCNKVPWGDYHPKN VYWGQGTQVTVSS |
| 416. | 02F02 | EVQLVESGGGLVQPGRSLTLSCAASTNIFSKSPMGWYRQAPGKQRELVAAIHG SSTLYADSVKGRFTISRDNAKNSIYLQMNSLRPEDTALYYCNKVPWGDYHPGN VYWGQGTQVTVSS |
| 417. | 02H01 | EVQLVESGGGLVQPGRSLTLSCAASTNIFSKSPMGWYRQAPGKQRELVAAIHG SSTLYADSVKGRFTISRDNAKNSIYLQMNSLRPEDTALYYCNKVPWGDYHPRN VYWGQGTQVTVSS |
| 418. | 01G10 | EVQLVESGGGLVQPGRSLTLSCAASTNEFSISPMGWYRQAPGKQRELVAAIHG LSTLYADSVKGRFTISRDNAKNSIYLQMNSLRPEDTALYYCNKVPWGAYHPRN VYWGQGTQVTVSS |
| 419. | 02D11 | EVQLVESGGGLVQPGRSLTLSCAASTNEFSISPMGWYRQAPGKQRELVAAIHG ESTLYADSVKGRFTISRDNAKNSIYLQMNSLRPEDTALYYCNKVPWGDYHPGN VYWGQGTQVTVSS |
| 420. | 01B01 | EVQLVESGGGLVQPGRSLTLSCAASTNIPSISPMGWYRQAPGKQRELVAAIHG ESTLYADSVKGRFTISRDNAKNSIYLQMNSLRPEDTALYYCNKVPWGDYHPRN VAWGQGTQVTVSS |
| 421. | 01G11 | EVQLVESGGGLVQPGRSLTLSCAASTNIPSISPMGWYRQAPGKQRELVAAIHG ASTLYADSVKGRFTISRDNAKNSIYLQMNSLRPEDTALYYCNKVPWGDYHPRN VAWGQGTQVTVSS |
| 422. | 01H10 | EVQLVESGGGLVQPGRSLTLSCAASTNIPSISPMGWYRQAPGKQRELVAAIHG ESTLYADSVKGRFTISRDNAKNSIYLQMNSLRPEDTALYYCNKVPWGDYHPRN VYWGQGTQVTVSS |
| 423. | 01C04 | EVQLVESGGGLVQPGRSLTLSCAASTNIPSISPMGWYRQAPGKQRELVAAIHG DSTLYADSVKGRFTISRDNAKNSIYLQMNSLRPEDTALYYCNKVPWGDYHPRN VYWGQGTQVTVSS |
| 424. | 01D04 | EVQLVESGGGLVQPGRSLTLSCAASTNITSISPMGWYRQAPGKQRELVAAIHG VSTLYADSVKGRFTISRDNAKNSIYLQMNSLRPEDTALYYCNKVPWGDYHPRN VQWGQGTQVTVSS |
| 425. | 01E07 | EVQLVESGGGLVQPGRSLTLSCAASTNIPSISPMGWYRQAPGKQRELVAAIHG QSTLYADSVKGRFTISRDNAKNSIYLQMNSLRPEDTALYYCNKVPWGDYHPRN VQWGQGTQVTVSS |
| 426. | 02B11 | EVQLVESGGGLVQPGRSLTLSCAASTNIVSISPMGWYRQAPGKQRELVAAIHG DSTLYADSVKGRFTISRDNAKNSIYLQMNSLRPEDTALYYCNKVPWGDYHPRN VSWGQGTQVTVSS |
| 427. | 01F10 | EVQLVESGGGLVQPGRSLTLSCAASSNIFSISPMGWYRQAPGKQRELVAAIHG ESTLYADSVKGRFTISRDNAKNSIYLQMNSLRPEDTALYYCNKVPWGDYHPRN VTWGQGTQVTVSS |

| | | Sequence Table |
|---|---|---|
| 428. | 02G08 | EVQLVESGGGLVQPGRSLTLSCAASTNIDSISPMGWYRQAPGKQRELVAAIHG<br>ESTLYADSVKGRFTISRDNAKNSIYLQMNSLRPEDTALYYCNKVPWGDYHPRN<br>VTWGQGTQVTVSS |
| 429. | 02G11 | EVQLVESGGGLVQPGRSLTLSCAASTNIDSISPMGWYRQAPGKQRELVAAIHG<br>SSTLYADSVKGRFTISRDNAKNSIYLQMNSLRPEDTALYYCNKVPWGDYHPRN<br>VTWGQGTQVTVSS |
| 430. | 02H06 | EVQLVESGGGLVQPGRSLTLSCAASTNIRSISPMGWYRQAPGKQRELVAAIHG<br>SSTLYADSVKGRFTISRDNAKNSIYLQMNSLRPEDTALYYCNKVPWGDYHPRN<br>VVWGQGTQVTVSS |
| 431. | 01B02 | EVQLVESGGGLVQPGRSLTLSCAASTNITSISPMGWYRQAPGKQRELVAAISG<br>FSTLYADSVKGRFTISRDNAKNSIYLQMNSLRPEDTALYYCNEVPWGDYHPRN<br>VYWGQGTQVTVSS |
| 432. | 02H11 | EVQLVESGGGLVQPGRSLTLSCAASTNITSISPMGWYRQAPGKQRELVAAIHG<br>ESTLYADSVKGRFTISRDNAKNSIYLQMNSLRPEDTALYYCNKVPWGDYHPRN<br>VYWGQGTQVTVSS |
| 433. | 01F08 | EVQLVESGGGLVQPGRSLTLSCAASTNITSVSPMGWYRQAPGKQRELVAAIHG<br>PSTLYADSVKGRFTISRDNAKNSIYLQMNSLRPEDTALYYCNKVPWGDYHPTN<br>VYWGQGTQVTVSS |
| 434. | 01H01 | EVQLVESGGGLVQPGRSLTLSCAASTNIGSISPMGWYRQAPGKQRELVAAIHG<br>QSTLYADSVKGRFTISRDNAKNSIYLQMNSLRPEDTALYYCNKVPWGDYHPQN<br>VYWGQGTQVTVSS |
| 435. | 01E10 | EVQLVESGGGLVQPGRSLTLSCAASTNIESISPMGWYRQAPGKQRELVAAIHG<br>KSTLYADSVKGRFTISRDNAKNSIYLQMNSLRPEDTALYYCNKVPWGDYHPRR<br>VYWGQGTQVTVSS |
| 436. | 01G01 | EVQLVESGGGLVQPGRSLTLSCAASTNIVSISPMGWYRQAPGKQRELVAAIHG<br>DSTLYADSVKGRFTISRDNAKNSIYLQMNSLRPEDTALYYCNKVPWGDYHPRR<br>VYWGQGTQVTVSS |
| 437. | 01G04 | EVQLVESGGGLVQPGRSLTLSCAASTNIDSISPMGWYRQAPGKQRELVAAIHG<br>NSTLYADSVKGRFTISRDNAKNSIYLQMNSLRPEDTALYYCNKVPWGDYHPRM<br>VYWGQGTQVTVSS |
| 438. | 01A04 | EVQLVESGGGLVQPGRSLTLSCAASTNIFMISPMGWYRQAPGKQRELVAAIHG<br>DSTLYADSVKGRFTISRDNAKNSIYLQMNSLRPEDTALYYCNKVPWGRYHPRN<br>VYWGQGTQVTVSS |
| 439. | 01F12 | EVQLVESGGGLVQPGRSLTLSCAASTNIFRISPMGWYRQAPGKQRELVAAIHG<br>DSTLYADSVKGRFTISRDNAKNSIYLQMNSLRPEDTALYYCNKVPWGRYHPRN<br>VYWGQGTQVTVSS |
| 440. | 01B06 | EVQLVESGGGLVQPGRSLTLSCAASTNIFSISPMGWYRQAPGKQRELVAAIHG<br>DSTLYADSVKGRFTISRDNAKNSIYLQMNSLRPEDTALYYCNKVPWGEYHPRN<br>VYWGQGTQVTVSS |
| 441. | 01C06 | EVQLVESGGGLVQPGRSLTLSCAASTNIFSISPMGWYRQAPGKQRELVAAIHG<br>DSTLYADSVKGRFTISRDNAKNSIYLQMNSLRPEDTALYYCNKVPWGKYHPRN<br>VYWGQGTQVTVSS |
| 442. | 01B08 | EVQLVESGGGLVQPGRSLTLSCAASTNIESISPMGWYRQAPGKQRELVAAIHG<br>SSTLYADSVKGRFTISRDNAKNSIYLQMNSLRPEDTALYYCNKVPWGRYHPRN<br>VYWGQGTQVTVSS |
| 443. | 01C02 | EVQLVESGGGLVQPGRSLTLSCAASTNIESISPMGWYRQAPGKQRELVAAIHG<br>NSTLYADSVKGRFTISRDNAKNSIYLQMNSLRPEDTALYYCNKVPWGRYHPRN<br>VYWGQGTQVTVSS |
| 444. | 01C10 | EVQLVESGGGLVQPGRSLTLSCAASTNISSISPMGWYRQAPGKQRELVAAIHG<br>FSTLYADSVKGRFTISRDNAKNSIYLQMNSLRPEDTALYYCNKVPWGYYHPRN<br>VYWGQGTQVTVSS |
| 445. | 01F09 | EVQLVESGGGLVQPGRSLTLSCAASTNISSISPMGWYRQAPGKQRELVAAIHG<br>HSTLYADSVKGRFTISRDNAKNSIYLQMNSLRPEDTALYYCNKVPWGRYHPRN<br>VYWGQGTQVTVSS |
| 446. | 02D06 | EVQLVESGGGLVQPGRSLTLSCAASTNISSISPMGWYRQAPGKQRELVAAIHG<br>FSTVYADSVKGRFTISRDNAKNSIYLQMNSLRPEDTALYYCNKVPWGRYHPRN<br>VYWGQGTQVTVSS |

| | | Sequence Table |
|---|---|---|
| 447. | 01A06 | EVQLVESGGGLVQPGRSLTLSCAASTNIFSIRPMGWYRQAPGKQRELVAAIHG FSTVYADSVKGRFTISRDNAKNSIYLQMNSLRPEDTALYYCNKVPWGDYHPRN VYWGQGTQVTVSS |
| 448. | 01C07 | EVQLVESGGGLVQPGRSLTLSCAASTNIFSIYPMGWYRQAPGKQRELVAAIHG FSTYYADSVKGRFTISRDNAKNSIYLQMNSLRPEDTALYYCNKVPWGSYHPRN VYWGQGTQVTVSS |
| 449. | 01G09 | EVQLVESGGGLVQPGRSLTLSCAASTNIFNISPMGWYRQAPGKQRELVAAIHG FSTYYADSVKGRFTISRDNAKNSIYLQMNSLRPEDTALYYCNKVPWGRYHPRN VYWGQGTQVTVSS |
| 450. | 01F05 | EVQLVESGGGLVQPGRSLTLSCAASTNIFSSSPMGWYRQAPGKQRELVAAIHG FSTWYADSVKGRFTISRDNAKNSIYLQMNSLRPEDTALYYCNKVPWGRYHPRN VYWGQGTQVTVSS |
| 451. | 02B12 | EVQLVESGGGLVQPGRSLTLSCAASTNISSISPMGWYRQAPGKQRELVAAIHG FDTLYADSVKGRFTISRDNAKNSIYLQMNSLRPEDTALYYCNKVPWGDYHPRN VYWGQGTQVTVSS |
| 452. | 02G01 | EVQLVESGGGLVQPGRSLTLSCAASTNIFSINPMGWYRQAPGKQRELVAAIHG FDTLYADSVKGRFTISRDNAKNSIYLQMNSLRPEDTALYYCNKVPWGDYHPRN VSWGQGTQVTVSS |
| 453. | 01A09 | EVQLVESGGGLVQPGRSLTLSCAASTNIFSITPMGWYRQAPGKQRELVAAIHG RSTLYADSVKGRFTISRDNAKNSIYLQMNSLRPEDTALYYCNKVPWGSYHPRN VYWGQGTQVTVSS |
| 454. | 01H05 | EVQLVESGGGLVQPGRSLTLSCAASTNIFSITPMGWYRQAPGKQRELVAAIHG TSTLYADSVKGRFTISRDNAKNSIYLQMNSLRPEDTALYYCNKVPWGRYHPRN VYWGQGTQVTVSS |
| 455. | 02F06 | EVQLVESGGGLVQPGRSLTLSCAASTNIFSITPMGWYRQAPGKQRELVAAIHG ESTLYADSVKGRFTISRDNAKNSIYLQMNSLRPEDTALYYCNKVPWGRYHPRN VYWGQGTQVTVSS |
| 456. | 02G07 | EVQLVESGGGLVQPGRSLTLSCAASTNIFSITPMGWYRQAPGKQRELVAAIHG ESTLYADSVKGRFTISRDNAKNSIYLQMNSLRPEDTALYYCNKVPWGDYHPRD VYWGQGTQVTVSS |
| 457. | 01F07-M34Y | EVQLVESGGGLVQPGRSLTLSCAASTNIFSTSPYGWYRQAPGKQRELVAAIHG FSTIYADSVKGRFTISRDNAKNSIYLQMNSLRPEDTALYYCNKVPWGDYHPGN VYWGQGTQVTVSS |
| 458. | 01F01-M34G | EVQLVESGGGLVQPGRSLTLSCAASTNIFSTSPGGWYRQAPGKQRELVAAIHG FSTIYADSVKGRFTISRDNAKNSIYLQMNSLRPEDTALYYCNKVPWGDYHPGN VYWGQGTQVTVSS |
| 459. | 02G02-M34Y | EVQLVESGGGLVQPGRSLTLSCAASTNIFSITPYGWYRQAPGKQRELVAAIHG ASTLYADSVKGRFTISRDNAKNSIYLQMNSLRPEDTALYYCNKVPWGDYHPGN VYWGQGTQVTVSS |
| 460. | 02G02-M34G | EVQLVESGGGLVQPGRSLTLSCAASTNIFSITPGGWYRQAPGKQRELVAAIHG ASTLYADSVKGRFTISRDNAKNSIYLQMNSLRPEDTALYYCNKVPWGDYHPGN VYWGQGTQVTVSS |
| 461. | F1 | EVQLVESGGGLVQPGRSLTLSCAAS |
| 462. | F1 | EVQLVESGGGLVQPGRSLTLSCVAS |
| 463. | F2 | WYRQAPGKQRELVA |
| 464. | F3 | GRFTISRDNAKNSIYLQMNSLRPEDTALYYCNK |
| 465. | F3 | GRFTISRDNAKNSIYLQMNSLRPEDTALYYCNE |
| 466. | F4 | WGQGTQVTVSS |
| 467. | F4 | WGKGTQVTVSS |
| 468. | Human BCMA | MLQMAGQCSQNEYFDSLLHACIPCQLRCSSNTPPLTCQRYCNASVTNSVKGTN AILWTCLGLSLIISLAVFVLMFLLRKINSEPLKDEFKNTGSGLLGMANIDLEK SRTGDEIILPRGLEYTVEECTCEDCIKSKPKVDSDHCFPLPAMEEGATILVTT KTNDYCKSLPAALSATEIEKSISAR |
| 469. | Murine BCMA | MAQQCFHSEYFDSLLHACKPCHLRCSNPPATCQPYCDPSVTSSVKGTYTVLWI FLGLTLVLSLALFTISFLLRKMNPEALKDEPQSPGQLDGSAQLDKADTELTRI |

| | | Sequence Table |
|---|---|---|
| | | RAGDDRIFPRSLEYTVEECTCEDCVKSKPKGDSDHFFPLPAMEEGATILVTTK<br>TGDYGKSSVPTALQSVMGMEKPTHTR |
| 470. | Cynomolgus<br>BCMA | MLQMARQCSQNEYFDSLLHDCKPCQLRCSSTPPLTCQRYCNASMTNSVKGMNA<br>ILWTCLGLSLIISLAVFVLTFLLRKMSSEPLKDEFKNTGSGLLGMANIDLEKG<br>RTGDEIVLPRGLEYTVEECTCEDCIKNKPKVDSDHCFPLPAMEEGATILVTTK<br>TNDYCNSLSAALSVTEIEKSISAR |
| 471. | 6x His<br>tag | His-His-His-His-His-His |

| SEQ ID NO | Construct Name | Sequence |
|---|---|---|
| 472. | Exemplary<br>linker sequence | (GS)n |
| 473. | Exemplary<br>linker sequence | (GGS)n |
| 474. | Exemplary<br>linker sequence | (GGGS)n |
| 475. | Exemplary<br>linker sequence | (GGSG)n |
| 476. | Exemplary<br>linker sequence | (GGSGG)n |
| 477. | Exemplary<br>linker sequence | (GGGGS)n |
| 478. | Exemplary<br>linker sequence | (GGGGG)n |
| 479. | Exemplary<br>linker sequence | (GGG)n |
| 480. | Exemplary<br>linker sequence | (GGGGS)4 |
| 481. | Exemplary<br>linker sequence | (GGGGS)3 |
| 482. | Exemplary<br>linker sequence | LPETG |
| 483. | Exemplary BH2T<br>TriTAC™<br>sequence | EVQLVESGGGLVQPGRSLTLSCAASTNIFSISPMGWYRQAPGKQREL<br>VAAIHGFSTLYADSVKGRFTISRDNAKNSIYLQMNSLRPEDTALYYC<br>NKVPWGDYHPRNVYWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 484. | Exemplary 01A01<br>TriTAC™<br>sequence | EVQLVESGGGLVQPGRSLTLSCAASTDIFSISPMGWYRQAPGKQREL<br>VAAIHGGSTLYADSVKGRFTISRDNAKNSIYLQMNSLRPEDTALYYC<br>NKVPWGDYHPRNVAWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 485. | Exemplary 02E09<br>TriTAC™<br>sequence | EVQLVESGGGLVQPGRSLTLSCAASTNDFSISPMGWYRQAPGKQREL<br>VAAIHGGSTLYADSVKGRFTISRDNAKNSIYLQMNSLRPEDTALYYC<br>NKVPWGDYHPRNVAWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS |

| | | |
|---|---|---|
| | | Sequence Table |
| | | KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 486. | Exemplary 01B03<br>TriTAC™<br>sequence | EVQLVESGGGLVQPGRSLTLSCAASTNIFSKSPMGWYRQAPGKQREL<br>VAAIHGKSTLYADSVKGRFTISRDNAKNSIYLQMNSLRPEDTALYYC<br>NKVPWGDYHPRNVVWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 487. | Exemplary 01B04<br>TriTAC™<br>sequence | EVQLVESGGGLVQPGRSLTLSCAASTNDFSISPMGWYRQAPGKQREL<br>VAAIHGKSTLYADSVKGRFTISRDNAKNSIYLQMNSLRPEDTALYYC<br>NKVPWGDYHPRNVKWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 488. | Exemplary 02H05<br>TriTAC™<br>sequence | EVQLVESGGGLVQPGRSLTLSCAASTNQFSISPMGWYRQAPGKQREL<br>VAAIHGKSTLYADSVKGRFTISRDNAKNSIYLQMNSLRPEDTALYYC<br>NKVPWGDYHPRNVVWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 489. | Exemplary 01A02<br>TriTAC™<br>sequence | EVQLVESGGGLVQPGRSLTLSCAASTNIFSSSPMGWYRQAPGKQREL<br>VAAINGFSTLYADSVKGRFTISRDNAKNSIYLQMNSLRPEDTALYYC<br>NKVPWGDYHPRNVHWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 490. | Exemplary 01A05<br>TriTAC™<br>sequence | EVQLVESGGGLVQPGRSLTLSCAASTNIFSSSPMGWYRQAPGKQREL<br>VAAIHGFSTLYADSVKGRFTISRDNAKNSIYLQMNSLRPEDTALYYC<br>NKVPWGDYHPRNVYWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 491. | Exemplary 01B12<br>TriTAC™<br>sequence | EVQLVESGGGLVQPGRSLTLSCAASTNIFSTSPMGWYRQAPGKQREL<br>VAAIHGFQTLYADSVKGRFTISRDNAKNSIYLQMNSLRPEDTALYYC<br>NKVPWGDYHPRNVVWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |

| | | |
|---|---|---|
| 492. | Exemplary 01G06 TriTAC™ sequence | EVQLVESGGGLVQPGRSLTLSCAASTNIFSRSPMGWYRQAPGKQREL VAAIHGFETLYADSVKGRFTISRDNAKNSIYLQMNSLRPEDTALYYC NKVPWGDYHPRNVLWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 493. | Exemplary 02C05 TriTAC™ sequence | EVQLVESGGGLVQPGRSLTLSCAASTNIFSESPMGWYRQAPGKQREL VAAIHGFTTLYADSVKGRFTISRDNAKNSIYLQMNSLRPEDTALYYC NKVPWGDYHPRNVTWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 494. | Exemplary 02G09 TriTAC™ sequence | EVQLVESGGGLVQPGRSLTLSCAASTNIFSDSPMGWYRQAPGKQREL VAAIHGFSTLYADSVKGRFTISRDNAKNSIYLQMNSLRPEDTALYYC NKVPWGDYHPRNVAWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 495. | Exemplary 01C08 TriTAC™ sequence | EVQLVESGGGLVQPGRSLTLSCAASTNIFSNSPMGWYRQAPGKQREL VAAIHGGSTLYADSVKGRFTISRDNAKNSIYLQMNSLRPEDTALYYC NKVPWGDYHPRNVHWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 496. | Exemplary 02B01 TriTAC™ sequence | EVQLVESGGGLVQPGRSLTLSCAASTNIFSNSPMGWYRQAPGKQREL VAAIHGRSTLYADSVKGRFTISRDNAKNSIYLQMNSLRPEDTALYYC NKVPWGDYHPRNVMWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 497. | Exemplary 02E03 TriTAC™ sequence | EVQLVESGGGLVQPGRSLTLSCAASTNIFSNSPMGWYRQAPGKQREL VAAIHGPSTLYADSVKGRFTISRDNAKNSIYLQMNSLRPEDTALYYC NKVPWGDYHPRNVTWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 498. | Exemplary 01D03 TriTAC™ sequence | EVQLVESGGGLVQPGRSLTLSCAASTNIFSNSPMGWYRQAPGKQREL VAAIHGDSTLYADSVKGRFTISRDNAKNSIYLQMNSLRPEDTALYYC NKVPWGDYHPRNVRWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ |

| | | Sequence Table |
|---|---|---|
| | | GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 499. | Exemplary 01D06<br>TriTAC™<br>sequence | EVQLVESGGGLVQPGRSLTLSCAASTNIFSRSPMGWYRQAPGKQREL<br>VAAIHGDSTLYADSVKGRFTISRDNAKNSIYLQMNSLRPEDTALYYC<br>NKVPWGDYHPRNVTWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 500. | Exemplary 01H04<br>TriTAC™<br>sequence | EVQLVESGGGLVQPGRSLTLSCAASTNIFSKSPMGWYRQAPGKQREL<br>VAAIHGQSTLYADSVKGRFTISRDNAKNSIYLQMNSLRPEDTALYYC<br>NKVPWGDYHPRNVTWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 501. | Exemplary 02B07<br>TriTAC™<br>sequence | EVQLVESGGGLVQPGRSLTLSCAASTNIFSSSPMGWYRQAPGKQREL<br>VAAIHGHSTLYADSVKGRFTISRDNAKNSIYLQMNSLRPEDTALYYC<br>NKVPWGDYHPRNVTWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 502. | Exemplary 01A08<br>TriTAC™<br>sequence | EVQLVESGGGLVQPGRSLTLSCAASTNIFSSSPMGWYRQAPGKQREL<br>VAAIHGESTLYADSVKGRFTISRDNAKNSIYLQMNSLRPEDTALYYC<br>NKVPWGDYHPRKVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 503. | Exemplary 01B07<br>TriTAC™<br>sequence | EVQLVESGGGLVQPGRSLTLSCAASTNIFSRSPMGWYRQAPGKQREL<br>VAAIHGNSTLYADSVKGRFTISRDNAKNSIYLQMNSLRPEDTALYYC<br>NKVPWGIYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 504. | Exemplary 01F03<br>TriTAC™<br>sequence | EVQLVESGGGLVQPGRSLTLSCAASTNIFSESPMGWYRQAPGKQREL<br>VAAIHGNSTLYADSVKGRFTISRDNAKNSIYLQMNSLRPEDTALYYC<br>NKVPWGTYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS |

| | | |
|---|---|---|
| | | KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 505. | Exemplary 02F05<br>TriTAC™<br>sequence | EVQLVESGGGLVQPGRSLTLSCAASTNIFSVSPMGWYRQAPGKQREL<br>VAAIHGNSTLYADSVKGRFTISRDNAKNSIYLQMNSLRPEDTALYYC<br>NKVPWGKYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 506. | Exemplary 02H04<br>TriTAC™<br>sequence | EVQLVESGGGLVQPGRSLTLSCAASTNIFSVSPMGWYRQAPGKQREL<br>VAAIHGNSTLYADSVKGRFTISRDNAKNSIYLQMNSLRPEDTALYYC<br>NKVPWGDYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 507. | Exemplary 02A07<br>TriTAC™<br>sequence | EVQLVESGGGLVQPGRSLTLSCAASTNIFSKSPMGWYRQAPGKQREL<br>VAAIHGNSTLYADSVKGRFTISRDNAKNSIYLQMNSLRPEDTALYYC<br>NKVPWGDYHPREVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 508. | Exemplary 01D05<br>TriTAC™<br>sequence | EVQLVESGGGLVQPGRSLTLSCAASTNIFSDSPMGWYRQAPGKQREL<br>VAAIHGTSTLYADSVKGRFTISRDNAKNSIYLQMNSLRPEDTALYYC<br>NKVPWGDYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 509. | Exemplary 01E05<br>TriTAC™<br>sequence | EVQLVESGGGLVQPGRSLTLSCAASTNIFSRSPMGWYRQAPGKQREL<br>VAAIHGTSTLYADSVKGRFTISRDNAKNSIYLQMNSLRPEDTALYYC<br>NKVPWGKYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 510. | Exemplary 01F02<br>TriTAC™<br>sequence | EVQLVESGGGLVQPGRSLTLSCAASTNIFSHSPMGWYRQAPGKQREL<br>VAAIHGTSTLYADSVKGRFTISRDNAKNSIYLQMNSLRPEDTALYYC<br>NKVPWGRYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |

| | | |
|---|---|---|
| | | Sequence Table |
| 511. | Exemplary 02C06 TriTAC™ sequence | EVQLVESGGGLVQPGRSLTLSCAASTNIFSTSPMGWYRQAPGKQREL VAAIHGTSTLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 512. | Exemplary 02F11 TriTAC™ sequence | EVQLVESGGGLVQPGRSLTLSCAASTNIFSTSPMGWYRQAPGKQREL VAAIHGTSTLYADSVKGRFTISRDNAKNSIYLQMNSLRPEDTALYYC NKVPWGDYHPRNVQWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 513. | Exemplary 01E06 TriTAC™ sequence | EVQLVESGGGLVQPGRSLTLSCAASTNIFSLSPMGWYRQAPGKQREL VAAIHGDSTLYADSVKGRFTISRDNAKNSIYLQMNSLRPEDTALYYC NKVPWGDYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 514. | Exemplary 01A03 TriTAC™ sequence | EVQLVESGGGLVQPGRSLTLSCAASTNIFSISPGGWYRQAPGKQREL VAAIHGSSTLYADSVKGRFTISRDNAKNSIYLQMNSLRPEDTALYYC NKVPWGDYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 515. | Exemplary 02A11 TriTAC™ sequence | EVQLVESGGGLVQPGRSLTLSCAASTNHFSISPMGWYRQAPGKQREL VAAIHGSSTLYADSVKGRFTISRDNAKNSIYLQMNSLRPEDTALYYC NKVPWGDYHPRVVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 516. | Exemplary 01D07 TriTAC™ sequence | EVQLVESGGGLVQPGRSLTLSCAASTNIFSASPMGWYRQAPGKQREL VAAIHGSSTLYADSVKGRFTISRDNAKNSIYLQMNSLRPEDTALYYC NKVPWGDYHPRNVNWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 517. | Exemplary 01D10 TriTAC™ sequence | EVQLVESGGGLVQPGRSLTLSCAASTNIFSASPMGWYRQAPGKQREL VAAIHGSSTLYADSVKGRFTISRDNAKNSIYLQMNSLRPEDTALYYC NKVPWGRYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ |

| | | |
|---|---|---|
| | | GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 518. | Exemplary 01A07
TriTAC™
sequence | EVQLVESGGGLVQPGRSLTLSCAASTNISSISPMGWYRQAPGKQREL
VAAIHGTSTLYADSVKGRFTISRDNAKNSIYLQMNSLRPEDTALYYC
NKVPWGDYHPGNVYWGQGTQVTVSSGGGGSGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 519. | Exemplary 02F12
TriTAC™
sequence | EVQLVESGGGLVQPGRSLTLSCAASTNIESISPMGWYRQAPGKQREL
VAAIHGTSTLYADSVKGRFTISRDNAKNSIYLQMNSLRPEDTALYYC
NKVPWGDYHPGNVYWGQGTQVTVSSGGGGSGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 520. | Exemplary 02B05
TriTAC™
sequence | EVQLVESGGGLVQPGRSLTLSCAASTNIFSISPYGWYRQAPGKQREL
VAAIHGTSTLYADSVKGRFTISRDNAKNSIYLQMNSLRPEDTALYYC
NKVPWGDYHPGNVYWGQGTQVTVSSGGGGSGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 521. | Exemplary 01E04
TriTAC™
sequence | EVQLVESGGGLVQPGRSLTLSCAASTNIASISPMGWYRQAPGKQREL
VAAIHGTSTLYADSVKGRFTISRDNAKNSIYLQMNSLRPEDTALYYC
NKVPWGDYHPGNVYWGQGTQVTVSSGGGGSGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 522. | Exemplary 02A05
TriTAC™
sequence | EVQLVESGGGLVQPGRSLTLSCAASTNIASISPMGWYRQAPGKQREL
VAAIHGKSTLYADSVKGRFTISRDNAKNSIYLQMNSLRPEDTALYYC
NKVPWGDYHPGNVYWGQGTQVTVSSGGGGSGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 523. | Exemplary 02C03
TriTAC™
sequence | EVQLVESGGGLVQPGRSLTLSCAASTNIASISPMGWYRQAPGKQREL
VAAIHGSSTLYADSVKGRFTISRDNAKNSIYLQMNSLRPEDTALYYC
NKVPWGDYHPGNVYWGQGTQVTVSSGGGGSGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS |

| | | Sequence Table |
|---|---|---|
| | | KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 524. | Exemplary 01E03 TriTAC™ sequence | EVQLVESGGGLVQPGRSLTLSCAASTNITSISPMGWYRQAPGKQREL
VAAIHGDSTLYADSVKGRFTISRDNAKNSIYLQMNSLRPEDTALYYC
NKVPWGDYHPGNVYWGQGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 525. | Exemplary 01H09 TriTAC™ sequence | EVQLVESGGGLVQPGRSLTLSCAASTNIMSISPMGWYRQAPGKQREL
VAAIHGNSTLYADSVKGRFTISRDNAKNSIYLQMNSLRPEDTALYYC
NKVPWGDYHPGNVYWGQGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 526. | Exemplary 02G05 TriTAC™ sequence | EVQLVESGGGLVQPGRSLTLSCAASTNITSISPMGWYRQAPGKQREL
VAAIHGNSTLYADSVKGRFTISRDNAKNSIYLQMNSLRPEDTALYYC
NKVPWGDYHPGNVYWGQGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 527. | Exemplary 01C01 TriTAC™ sequence | EVQLVESGGGLVQPGRSLTLSCAASTNIVSISPMGWYRQAPGKQREL
VAAIHGHSTLYADSVKGRFTISRDNAKNSIYLQMNSLRPEDTALYYC
NKVPWGDYHPGNVYWGQGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 528. | Exemplary 01D02 TriTAC™ sequence | EVQLVESGGGLVQPGRSLTLSCAASTNIVSISPMGWYRQAPGKQREL
VAAIHGKSTLYADSVKGRFTISRDNAKNSIYLQMNSLRPEDTALYYC
NKVPWGDYHPGNVYWGQGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 529. | Exemplary 02D09 TriTAC™ sequence | EVQLVESGGGLVQPGRSLTLSCAASTNVVSISPMGWYRQAPGKQREL
VAAIHGKSTLYADSVKGRFTISRDNAKNSIYLQMNSLRPEDTALYYC
NKVPWGDYHPNNVYWGQGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |

| | | Sequence Table |
|---|---|---|
| 530. | Exemplary 02C01 TriTAC™ sequence | EVQLVESGGGLVQPGRSLTLSCAASTNIISISPMGWYRQAPGKQREL VAAIHGASTLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 531. | Exemplary 02G02 TriTAC™ sequence | EVQLVESGGGLVQPGRSLTLSCAASTNIFSITPMGWYRQAPGKQREL VAAIHGASTLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 532. | Exemplary 01B05 TriTAC™ sequence | EVQLVESGGGLVQPGRSLTLSCAASTNITSISPMGWYRQAPGKQREL VAAIHGFETLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 533. | Exemplary 01G08 TriTAC™ sequence | EVQLVESGGGLVQPGRSLTLSCAASTNIQSISPMGWYRQAPGKQREL VAAIHGFETLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 534. | Exemplary 01H06 TriTAC™ sequence | EVQLVESGGGLVQPGRSLTLSCAASTSDFSISPMGWYRQAPGKQREL VAAIHGFETLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 535. | Exemplary 01F04 TriTAC™ sequence | EVQLVESGGGLVQPGRSLTLSCAASTNIDSISPMGWYRQAPGKQREL VAAIHGFQTLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 536. | Exemplary 01H08 TriTAC™ sequence | EVQLVESGGGLVQPGRSLTLSCAASTNIMSISPMGWYRQAPGKQREL VAAIHGFSTVYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ |

| | | Sequence Table |
|---|---|---|
| | | GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 537. | Exemplary 02F07<br>TriTAC™<br>sequence | EVQLVESGGGLVQPGRSLTLSCAASTNIESISPMGWYRQAPGKQREL<br>VAAIHGFSTLYADSVKGRFTISRDNAKNSIYLQMNSLRPEDTALYYC<br>NKVPWGDYHPGNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 538. | Exemplary 01C05<br>TriTAC™<br>sequence | EVQLVESGGGLVQPGRSLTLSCAASTNIFSSSPMGWYRQAPGKQREL<br>VAAIHGFKTLYADSVKGRFTISRDNAKNSIYLQMNSLRPEDTARYYC<br>NKVPWGDYHPGNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 539. | Exemplary 02F04<br>TriTAC™<br>sequence | EVQLVESGGGLVQPGRSLTLSCAASTNIFSSSPMGWYRQAPGKQREL<br>VAAIHGFSTLYADSVKGRFTISRDNAKNSIYLQMNSLRPEDTALYYC<br>NKVPWGDYHPGNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 540. | Exemplary 02B06<br>TriTAC™<br>sequence | EVQLVESGGGLVQPGRSLTLSCAASTNIFSNSPMGWYRQAPGKQREL<br>VAAIHGFSTLYADSVKGRFTISRDNAKNSIYLQMNSLRPEDTALYYC<br>NKVPWGDYHPGNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 541. | Exemplary 01F07<br>TriTAC™<br>sequence | EVQLVESGGGLVQPGRSLTLSCAASTNIFSTSPMGWYRQAPGKQREL<br>VAAIHGFSTIYADSVKGRFTISRDNAKNSIYLQMNSLRPEDTALYYC<br>NKVPWGDYHPGNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 542. | Exemplary 02B04<br>TriTAC™<br>sequence | EVQLVESGGGLVQPGRSLTLSCAASTNIFSTSPMGWYRQAPGKQREL<br>VAAIHGFSTIYADSVKGRFTISRDNAKNSIYLQMNSLRPEDTALYYC<br>NKVPWGDYHPLNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGSEVQLVESGGGLVQPGGSLKLSCAASGFTFN<br>KYAINWVRQAPGKGLEWVARIRSKYNNYATYYADQVKDRFTISRDDS |

| | | Sequence Table |
|---|---|---|
| | | KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 543. | Exemplary 01H11 TriTAC™ sequence | EVQLVESGGGLVQPGRSLTLSCVASTNIFSTSPMGWYRQAPGKQREL
VAAIHGFSTLYADSVKGRFTISRDNAKNSIYLQMNSLRPEDTALYYC
NKVPWGDYHPGNVYWGQGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 544. | Exemplary 02E06 TriTAC™ sequence | EVQLVESGGGLVQPGRSLTLSCAASTNIFSDSPMGWYRQAPGKQREL
VAAIHGFSTFYADSVKGRFTISRDNAKNSIYLQMNSLRPEDTALYYC
NKVPWGDYHPGNVYWGQGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 545. | Exemplary 01E08 TriTAC™ sequence | EVQLVESGGGLVQPGRSLTLSCAASTNIFSQSPMGWYRQAPGKQREL
VAAIHGDSTLYADSVKGRFTISRDNAKNSIYLQMNSLRPEDTALYYC
NKVPWGDYHPGNVCWGQGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 546. | Exemplary 02A04 TriTAC™ sequence | EVQLVESGGGLVQPGRSLTLSCAASTNIFSQSPMGWYRQAPGKQREL
VAAIHGKSTLYADSVKGRFTISRDNAKNSIYLQMNSLRPEDTALYYC
NKVPWGDYHPSNVYWGKGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 547. | Exemplary 02A08 TriTAC™ sequence | EVQLVESGGGLVQPGRSLTLSCAASTNIFSRSPMGWYRQAPGKQREL
VAAIHGESTLYADSVKGRFTISRDNAKNSIYLQMNSLRPEDTALYYC
NKVPWGRYHPGNVYWGQGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 548. | Exemplary 02E05 TriTAC™ sequence | EVQLVESGGGLVQPGRSLTLSCAASTNIFSRSPMGWYRQAPGKQREL
VAAIHGISTLYADSVKGRFTISRDNAKNSIYLQMNSLRPEDTALYYC
NKVPWGDYHPGNVYWGQGTQVTVSSGGGGSGGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |

| | | |
|---|---|---|
| | | Sequence Table |
| 549. | Exemplary 02H09 TriTAC™ sequence | EVQLVESGGGLVQPGRSLTLSCAASTNIFSRSPMGWYRQAPGKQREL VAAIHGSSTLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 550. | Exemplary 02G06 TriTAC™ sequence | EVQLVESGGGLVQPGRSLTLSCAASTNIFSGSPMGWYRQAPGKQREL VAAIHGNSTLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 551. | Exemplary 01B09 TriTAC™ sequence | EVQLVESGGGLVQPGRSLTLSCAASSNIFSISPMGWYRQAPGKQREL VAAIHGSSTLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 552. | Exemplary 02F03 TriTAC™ sequence | EVQLVESGGGLVQPGRSLTLSCAASTNIFSIYPMGWYRQAPGKQREL VAAIHGSSTLYADSVKGRFTISRDNAKNSIYLQMNSLRPEDTALYYC NKVPWGDYHPKNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 553. | Exemplary 02F02 TriTAC™ sequence | EVQLVESGGGLVQPGRSLTLSCAASTNIFSKSPMGWYRQAPGKQREL VAAIHGSSTLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 554. | Exemplary 02H01 TriTAC™ sequence | EVQLVESGGGLVQPGRSLTLSCAASTNIFSKSPMGWYRQAPGKQREL VAAIHGSSTLYADSVKGRFTISRDNAKNSIYLQMNSLRPEDTALYYC NKVPWGDYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 555. | Exemplary 01G10 TriTAC™ sequence | EVQLVESGGGLVQPGRSLTLSCAASTNEFSISPMGWYRQAPGKQREL VAAIHGLSTLYADSVKGRFTISRDNAKNSIYLQMNSLRPEDTALYYC NKVPWGAYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ |

| | | Sequence Table |
|---|---|---|
| | | GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 556. | Exemplary 02D11 TriTAC™ sequence | EVQLVESGGGLVQPGRSLTLSCAASTNEFSISPMGWYRQAPGKQREL VAAIHGESTLYADSVKGRFTISRDNAKNSIYLQMNSLRPEDTALYYC NKVPWGDYHPGNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 557. | Exemplary 01B01 TriTAC™ sequence | EVQLVESGGGLVQPGRSLTLSCAASTNIPSISPMGWYRQAPGKQREL VAAIHGESTLYADSVKGRFTISRDNAKNSIYLQMNSLRPEDTALYYC NKVPWGDYHPRNVAWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 558. | Exemplary 01G11 TriTAC™ sequence | EVQLVESGGGLVQPGRSLTLSCAASTNIPSISPMGWYRQAPGKQREL VAAIHGASTLYADSVKGRFTISRDNAKNSIYLQMNSLRPEDTALYYC NKVPWGDYHPRNVAWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 559. | Exemplary 01H10 TriTAC™ sequence | EVQLVESGGGLVQPGRSLTLSCAASTNIPSISPMGWYRQAPGKQREL VAAIHGESTLYADSVKGRFTISRDNAKNSIYLQMNSLRPEDTALYYC NKVPWGDYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 560. | Exemplary 01C04 TriTAC™ sequence | EVQLVESGGGLVQPGRSLTLSCAASTNIPSISPMGWYRQAPGKQREL VAAIHGDSTLYADSVKGRFTISRDNAKNSIYLQMNSLRPEDTALYYC NKVPWGDYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 561. | Exemplary 01D04 TriTAC™ sequence | EVQLVESGGGLVQPGRSLTLSCAASTNITSISPMGWYRQAPGKQREL VAAIHGVSTLYADSVKGRFTISRDNAKNSIYLQMNSLRPEDTALYYC NKVPWGDYHPRNVQWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS |

| | | |
|---|---|---|
| | | SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 562. | Exemplary 01E07<br>TriTAC™<br>sequence | EVQLVESGGGLVQPGRSLTLSCAASTNIPSISPMGWYRQAPGKQREL<br>VAAIHGQSTLYADSVKGRFTISRDNAKNSIYLQMNSLRPEDTALYYC<br>NKVPWGDYHPRNVQWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 563. | Exemplary 02B11<br>TriTAC™<br>sequence | EVQLVESGGGLVQPGRSLTLSCAASTNIVSISPMGWYRQAPGKQREL<br>VAAIHGDSTLYADSVKGRFTISRDNAKNSIYLQMNSLRPEDTALYYC<br>NKVPWGDYHPRNVSWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 564. | Exemplary 01F10<br>TriTAC™<br>sequence | EVQLVESGGGLVQPGRSLTLSCAASSNIFSISPMGWYRQAPGKQREL<br>VAAIHGESTLYADSVKGRFTISRDNAKNSIYLQMNSLRPEDTALYYC<br>NKVPWGDYHPRNVTWGQGTQVTVSS<br>GGGGSGGGGSEVQLVESGGGLVQPGNSLRLSCAASGFTFSKFGMSWVR<br>QAPGKGLEWVSSISGSGRDTLYADSVKGRFTISRDNAKTTLYLQMNS<br>LRPEDTAVYYCTIGGSLSVSSQGTLVTVSSGGGGSGGGGSEVQLVESG<br>GGLVQPGGSLKLSCAASGFTFNKYAINWVRQAPGKGLEWVARIRSKY<br>NNYATYYADQVKDRFTISRDDSKNTAYLQMNNLKTEDTAVYYCVRHA<br>NFGNSYISYWAYWGQGTLVTVSSGGGGSGGGGSGGGGSQTVVTQEPS<br>LTVSPGGTVTLTCASSTGAVTSGNYPNWVQQKPGQAPRGLIGGTKFL<br>VPGTPARFSGSLLGGKAALTLSGVQPEDEAEYYCTLWYSNRWVFGGG<br>TKLTVLHHHHHH |
| 565. | Exemplary 02G08<br>TriTAC™<br>sequence | EVQLVESGGGLVQPGRSLTLSCAASTNIDSISPMGWYRQAPGKQREL<br>VAAIHGESTLYADSVKGRFTISRDNAKNSIYLQMNSLRPEDTALYYC<br>NKVPWGDYHPRNVTWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 566. | Exemplary 02G11<br>TriTAC™<br>sequence | EVQLVESGGGLVQPGRSLTLSCAASTNIDSISPMGWYRQAPGKQREL<br>VAAIHGSSTLYADSVKGRFTISRDNAKNSIYLQMNSLRPEDTALYYC<br>NKVPWGDYHPRNVTWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 567. | Exemplary 02H06<br>TriTAC™<br>sequence | EVQLVESGGGLVQPGRSLTLSCAASTNIRSISPMGWYRQAPGKQREL<br>VAAIHGSSTLYADSVKGRFTISRDNAKNSIYLQMNSLRPEDTALYYC<br>NKVPWGDYHPRNVVWGQGTQVTVSSGGGGSGGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |

| | | |
|---|---|---|
| 568. | Exemplary 01B02 TriTAC™ sequence | EVQLVESGGGLVQPGRSLTLSCAASTNITSISPMGWYRQAPGKQREL VAAISGFSTLYADSVKGRFTISRDNAKNSIYLQMNSLRPEDTALYYC NEVPWGDYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 569. | Exemplary 02H11 TriTAC™ sequence | EVQLVESGGGLVQPGRSLTLSCAASTNITSISPMGWYRQAPGKQREL VAAIHGESTLYADSVKGRFTISRDNAKNSIYLQMNSLRPEDTALYYC NKVPWGDYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 570. | Exemplary 01F08 TriTAC™ sequence | EVQLVESGGGLVQPGRSLTLSCAASTNITSVSPMGWYRQAPGKQREL VAAIHGPSTLYADSVKGRFTISRDNAKNSIYLQMNSLRPEDTALYYC NKVPWGDYHPTNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 571. | Exemplary 01H01 TriTAC™ sequence | EVQLVESGGGLVQPGRSLTLSCAASTNIGSISPMGWYRQAPGKQREL VAAIHGQSTLYADSVKGRFTISRDNAKNSIYLQMNSLRPEDTALYYC NKVPWGDYHPQNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 572. | Exemplary 01E10 TriTAC™ sequence | EVQLVESGGGLVQPGRSLTLSCAASTNIESISPMGWYRQAPGKQREL VAAIHGKSTLYADSVKGRFTISRDNAKNSIYLQMNSLRPEDTALYYC NKVPWGDYHPRRVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 573. | Exemplary 01G01 TriTAC™ sequence | EVQLVESGGGLVQPGRSLTLSCAASTNIVSISPMGWYRQAPGKQREL VAAIHGDSTLYADSVKGRFTISRDNAKNSIYLQMNSLRPEDTALYYC NKVPWGDYHPRRVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 574. | Exemplary 01G04 TriTAC™ sequence | EVQLVESGGGLVQPGRSLTLSCAASTNIDSISPMGWYRQAPGKQREL VAAIHGNSTLYADSVKGRFTISRDNAKNSIYLQMNSLRPEDTALYYC NKVPWGDYHPRMVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ |

| | | |
|---|---|---|
| | | GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 575. | Exemplary 01A04 TriTAC™ sequence | EVQLVESGGGLVQPGRSLTLSCAASTNIFMISPMGWYRQAPGKQREL
VAAIHGDSTLYADSVKGRFTISRDNAKNSIYLQMNSLRPEDTALYYC
NKVPWGRYHPRNVYWGQGTQVTVSSGGGGSGGGSEVQLVESGGGLVQ
PGNSLRLSCAASGFTFSKFGMSWVRQAPGKGLEWVSSISGSRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 576. | Exemplary 01F12 TriTAC™ sequence | EVQLVESGGGLVQPGRSLTLSCAASTNIFRISPMGWYRQAPGKQREL
VAAIHGDSTLYADSVKGRFTISRDNAKNSIYLQMNSLRPEDTALYYC
NKVPWGRYHPRNVYWGQGTQVTVSSGGGGSGGGSEVQLVESGGGLVQ
PGNSLRLSCAASGFTFSKFGMSWVRQAPGKGLEWVSSISGSRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 577. | Exemplary 01B06 TriTAC™ sequence | EVQLVESGGGLVQPGRSLTLSCAASTNIFSISPMGWYRQAPGKQREL
VAAIHGDSTLYADSVKGRFTISRDNAKNSIYLQMNSLRPEDTALYYC
NKVPWGEYHPRNVYWGQGTQVTVSSGGGGSGGGSEVQLVESGGGLVQ
PGNSLRLSCAASGFTFSKFGMSWVRQAPGKGLEWVSSISGSRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 578. | Exemplary 01C06 TriTAC™ sequence | EVQLVESGGGLVQPGRSLTLSCAASTNIFSISPMGWYRQAPGKQREL
VAAIHGDSTLYADSVKGRFTISRDNAKNSIYLQMNSLRPEDTALYYC
NKVPWGKYHPRNVYWGQGTQVTVSSGGGGSGGGSEVQLVESGGGLVQ
PGNSLRLSCAASGFTFSKFGMSWVRQAPGKGLEWVSSISGSRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 579. | Exemplary 01B08 TriTAC™ sequence | EVQLVESGGGLVQPGRSLTLSCAASTNIESISPMGWYRQAPGKQREL
VAAIHGSSTLYADSVKGRFTISRDNAKNSIYLQMNSLRPEDTALYYC
NKVPWGRYHPRNVYWGQGTQVTVSSGGGGSGGGSEVQLVESGGGLVQ
PGNSLRLSCAASGFTFSKFGMSWVRQAPGKGLEWVSSISGSRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 580. | Exemplary 01C02 TriTAC™ sequence | EVQLVESGGGLVQPGRSLTLSCAASTNIESISPMGWYRQAPGKQREL
VAAIHGNSTLYADSVKGRFTISRDNAKNSIYLQMNSLRPEDTALYYC
NKVPWGRYHPRNVYWGQGTQVTVSSGGGGSGGGSEVQLVESGGGLVQ
PGNSLRLSCAASGFTFSKFGMSWVRQAPGKGLEWVSSISGSRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS |

| | | Sequence Table |
|---|---|---|
| | | KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 581. | Exemplary 01C10<br>TriTAC™<br>sequence | EVQLVESGGGLVQPGRSLTLSCAASTNISSISPMGWYRQAPGKQREL<br>VAAIHGFSTLYADSVKGRFTISRDNAKNSIYLQMNSLRPEDTALYYC<br>NKVPWGYYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 582. | Exemplary 01F09<br>TriTAC™<br>sequence | EVQLVESGGGLVQPGRSLTLSCAASTNISSISPMGWYRQAPGKQREL<br>VAAIHGHSTLYADSVKGRFTISRDNAKNSIYLQMNSLRPEDTALYYC<br>NKVPWGRYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 583. | Exemplary 02D06<br>TriTAC™<br>sequence | EVQLVESGGGLVQPGRSLTLSCAASTNISSISPMGWYRQAPGKQREL<br>VAAIHGFSTVYADSVKGRFTISRDNAKNSIYLQMNSLRPEDTALYYC<br>NKVPWGRYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 584. | Exemplary 01A06<br>TriTAC™<br>sequence | EVQLVESGGGLVQPGRSLTLSCAASTNIFSIRPMGWYRQAPGKQREL<br>VAAIHGFSTVYADSVKGRFTISRDNAKNSIYLQMNSLRPEDTALYYC<br>NKVPWGDYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 585. | Exemplary 01C07<br>TriTAC™<br>sequence | EVQLVESGGGLVQPGRSLTLSCAASTNIFSIYPMGWYRQAPGKQREL<br>VAAIHGFSTYYADSVKGRFTISRDNAKNSIYLQMNSLRPEDTALYYC<br>NKVPWGSYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |
| 586. | Exemplary 01G09<br>TriTAC™<br>sequence | EVQLVESGGGLVQPGRSLTLSCAASTNIFNISPMGWYRQAPGKQREL<br>VAAIHGFSTYYADSVKGRFTISRDNAKNSIYLQMNSLRPEDTALYYC<br>NKVPWGRYHPRNVYWGQGTQVTVSSGGGGSGGGSEVQLVESGGGLVQ<br>PGNSLRLSCAASGFTFSKFGMSWVRQAPGKGLEWVSSISGSGRDTLY<br>ADSVKGRFTISRDNAKTTLYLQMNSLRPEDTAVYYCTIGGSLSVSSQ<br>GTLVTVSSGGGGSGGGGSEVQLVESGGGLVQPGGSLKLSCAASGFTFN<br>KYAINWVRQAPGKGLEWVARIRSKYNNYATYYADQVKDRFTISRDDS<br>KNTAYLQMNNLKTEDTAVYYCVRHANFGNSYISYWAYWGQGTLVTVS<br>SGGGGSGGGGSGGGGSQTVVTQEPSLTVSPGGTVTLTCASSTGAVTS<br>GNYPNWVQQKPGQAPRGLIGGTKFLVPGTPARFSGSLLGGKAALTLS<br>GVQPEDEAEYYCTLWYSNRWVFGGGTKLTVLHHHHHH |

| | | |
|---|---|---|
| 587. | Exemplary 01F05 TriTAC™ sequence | EVQLVESGGGLVQPGRSLTLSCAASTNIFSSSPMGWYRQAPGKQREL VAAIHGFSTWYADSVKGRFTISRDNAKNSIYLQMNSLRPEDTALYYC NKVPWGRYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 588. | Exemplary 02B12 TriTAC™ sequence | EVQLVESGGGLVQPGRSLTLSCAASTNISSISPMGWYRQAPGKQREL VAAIHGFDTLYADSVKGRFTISRDNAKNSIYLQMNSLRPEDTALYYC NKVPWGDYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 589. | Exemplary 02G01 TriTAC™ sequence | EVQLVESGGGLVQPGRSLTLSCAASTNIFSINPMGWYRQAPGKQREL VAAIHGFDTLYADSVKGRFTISRDNAKNSIYLQMNSLRPEDTALYYC NKVPWGDYHPRNVSWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 590. | Exemplary 01A09 TriTAC™ sequence | EVQLVESGGGLVQPGRSLTLSCAASTNIFSITPMGWYRQAPGKQREL VAAIHGRSTLYADSVKGRFTISRDNAKNSIYLQMNSLRPEDTALYYC NKVPWGSYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 591. | Exemplary 01H05 TriTAC™ sequence | EVQLVESGGGLVQPGRSLTLSCAASTNIFSITPMGWYRQAPGKQREL VAAIHGTSTLYADSVKGRFTISRDNAKNSIYLQMNSLRPEDTALYYC NKVPWGRYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 592. | Exemplary 02F06 TriTAC™ sequence | EVQLVESGGGLVQPGRSLTLSCAASTNIFSITPMGWYRQAPGKQREL VAAIHGESTLYADSVKGRFTISRDNAKNSIYLQMNSLRPEDTALYYC NKVPWGRYHPRNVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ GTLVTVSSGGGGSGGGSEVQLVESGGGLVQPGGSLKLSCAASGFTFN KYAINWVRQAPGKGLEWVARIRSKYNNYATYYADQVKDRFTISRDDS KNTAYLQMNNLKTEDTAVYYCVRHANFGNSYISYWAYWGQGTLVTVS SGGGGSGGGGSGGGGSQTVVTQEPSLTVSPGGTVTLTCASSTGAVTS GNYPNWVQQKPGQAPRGLIGGTKFLVPGTPARFSGSLLGGKAALTLS GVQPEDEAEYYCTLWYSNRWVFGGGTKLTVLHHHHHH |
| 593. | Exemplary 02G07 TriTAC™ sequence | EVQLVESGGGLVQPGRSLTLSCAASTNIFSITPMGWYRQAPGKQREL VAAIHGESTLYADSVKGRFTISRDNAKNSIYLQMNSLRPEDTALYYC NKVPWGDYHPRDVYWGQGTQVTVSSGGGGSGGGSEVQLVESGGGLVQ PGNSLRLSCAASGFTFSKFGMSWVRQAPGKGLEWVSSISGSGRDTLY ADSVKGRFTISRDNAKTTLYLQMNSLRPEDTAVYYCTIGGSLSVSSQ |

| | | Sequence Table |
|---|---|---|
| | | GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 594. | Exemplary
01F07-M34Y
TriTAC™
sequence | EVQLVESGGGLVQPGRSLTLSCAASTNIFSTSPYGWYRQAPGKQREL
VAAIHGFSTIYADSVKGRFTISRDNAKNSIYLQMNSLRPEDTALYYC
NKVPWGDYHPGNVYWGQGTQVTVSSGGGGSGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 595. | Exemplary
01F01-M34G
TriTAC™
sequence | EVQLVESGGGLVQPGRSLTLSCAASTNIFSTSPGGWYRQAPGKQREL
VAAIHGFSTIYADSVKGRFTISRDNAKNSIYLQMNSLRPEDTALYYC
NKVPWGDYHPGNVYWGQGTQVTVSSGGGGSGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 596. | Exemplary
02G02-M34Y
TriTAC™
sequence | EVQLVESGGGLVQPGRSLTLSCAASTNIFSITPYGWYRQAPGKQREL
VAAIHGASTLYADSVKGRFTISRDNAKNSIYLQMNSLRPEDTALYYC
NKVPWGDYHPGNVYWGQGTQVTVSSGGGGSGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 597. | Exemplary
02G02-M34G
TriTAC™
sequence | EVQLVESGGGLVQPGRSLTLSCAASTNIFSITPGGWYRQAPGKQREL
VAAIHGASTLYADSVKGRFTISRDNAKNSIYLQMNSLRPEDTALYYC
NKVPWGDYHPGNVYWGQGTQVTVSSGGGGSGGGSEVQLVESGGGLVQ
PGNSLRLSCAASGFTFSKFGMSWVRQAPGKGLEWVSSISGSGRDTLY
ADSVKGRFTISRDNAKTTLYLQMNSLRPEDTAVYYCTIGGSLSVSSQ
GTLVTVSSGGGGSGGGSEVQLVESGGGLVQPGGSLKLSCAASGFTFN
KYAINWVRQAPGKGLEWVARIRSKYNNYATYYADQVKDRFTISRDDS
KNTAYLQMNNLKTEDTAVYYCVRHANFGNSYISYWAYWGQGTLVTVS
SGGGGSGGGGSGGGGSQTVVTQEPSLTVSPGGTVTLTCASSTGAVTS
GNYPNWVQQKPGQAPRGLIGGTKFLVPGTPARFSGSLLGGKAALTLS
GVQPEDEAEYYCTLWYSNRWVFGGGTKLTVLHHHHHH |
| 598. | 253BH10 (llama
anti-BCMA
antibody) | QVQLVESGGGLVQPGESLRLSCAASTNIFSISPMGWYRQAPGKQREL
VAAIHGFSTLYADSVKGRFTISRDNAKNTIYLQMNSLKPEDTAVYYC
NKVPWGDYHPRNVYWGQGTQVTVSS |
| 599. | 253BH10 CDR1 | TNIFSISPMG |
| 600. | 253BH10 CDR2 | AIHGFSTLYADSVK |
| 601. | 253BH10 CDR3 | VPWGDYHPRNVY |

SEQUENCE LISTING (601 sequences)

SEQ ID NO: 1 - protein, 10 aa, Artificial Sequence
  Description of Artificial Sequence: Synthetic peptide
  MOD_RES (1)..(1): Thr or Ser
  MOD_RES (2)..(2): Asn, Asp or Ser
  MOD_RES (3)..(3): Ile, Asp, Gln, His, Val or Glu
  MOD_RES (4)..(4): Phe, Ser, Glu, Ala, Thr, Met, Val, Ile, Asp, Gln, Pro, Arg or Gly
  MOD_RES (5)..(5): Ser, Met, Arg or Asn
  MOD_RES (6)..(6): Ile, Lys, Ser, Thr, Arg, Glu, Asp, Asn, Val, His, Leu, Ala, Gln or Gly
  MOD_RES (7)..(7): Ser, Thr, Tyr, Arg or Asn
  MOD_RES (9)..(9): Met, Gly or Tyr
XXXXXXXPXG

SEQ ID NO: 2 - protein, 14 aa, Artificial Sequence
  Description of Artificial Sequence: Synthetic peptide
  MOD_RES (3)..(3): His, Asn or Ser
  MOD_RES (5)..(5): Phe, Gly, Lys, Arg, Pro, Asp, Gln, His, Glu, Asn, Thr, Ser, Ala, Ile, Leu or Val
  MOD_RES (6)..(6): Ser, Gln, Glu, Thr, Lys or Asp
  MOD_RES (8)..(8): Leu, Val, Ile, Phe, Tyr or Trp
AIXGXXTXYADSVK

SEQ ID NO: 3 - protein, 12 aa, Artificial Sequence
  Description of Artificial Sequence: Synthetic peptide
  MOD_RES (5)..(5): Asp, Ile, Thr, Lys, Arg, Ala, Glu, Ser or Tyr
  MOD_RES (9)..(9): Arg, Gly, Leu, Lys, Thr, Gln, Ser or Asn
  MOD_RES (10)..(10): Asn, Lys, Glu, Val, Arg, Met or Asp
  MOD_RES (12)..(12): Tyr, Ala, Val, Lys, His, Leu, Met, Thr, Arg, Gln, Cys, Ser or Asn
VPWGXYHPXXVX

SEQ ID NO: 4 - protein, 10 aa, Artificial Sequence
  Description of Artificial Sequence: Synthetic peptide
TDIFSISPMG

SEQ ID NO: 5 - protein, 10 aa, Artificial Sequence
  Description of Artificial Sequence: Synthetic peptide
TNIFSSSPMG

SEQ ID NO: 6 - protein, 10 aa, Artificial Sequence
  Description of Artificial Sequence: Synthetic peptide
TNIFSISPGG

SEQ ID NO: 7 - protein, 10 aa, Artificial Sequence
  Description of Artificial Sequence: Synthetic peptide
TNIFMISPMG

SEQ ID NO: 8 - protein, 10 aa, Artificial Sequence
  Description of Artificial Sequence: Synthetic peptide
TNIFSSSPMG

SEQ ID NO: 9 - protein, 10 aa, Artificial Sequence
  Description of Artificial Sequence: Synthetic peptide
TNIFSIRPMG

SEQ ID NO: 10 - protein, 10 aa, Artificial Sequence
  Description of Artificial Sequence: Synthetic peptide
TNISSISPMG

SEQ ID NO: 11 - protein, 10 aa, Artificial Sequence
  Description of Artificial Sequence: Synthetic peptide
TNIFSSSPMG

SEQ ID NO: 12 - protein, 10 aa, Artificial Sequence
  Description of Artificial Sequence: Synthetic peptide
TNIFSITPMG

SEQ ID NO: 13 - protein, 10 aa, Artificial Sequence
  Description of Artificial Sequence: Synthetic peptide
TNIPSISPMG

SEQ ID NO: 14 - protein, 10 aa, Artificial Sequence
  Description of Artificial Sequence: Synthetic peptide
TNITSISPMG

SEQ ID NO: 15 - protein, 10 aa, Artificial Sequence
  Description of Artificial Sequence: Synthetic peptide
TNIFSKSPMG

SEQ ID NO: 16 - protein, 10 aa, Artificial Sequence
  Description of Artificial Sequence: Synthetic peptide
TNDFSISPMG

SEQ ID NO: 17 - protein, 10 aa, Artificial Sequence
  Description of Artificial Sequence: Synthetic peptide
TNITSISPMG

SEQ ID NO: 18 - protein, 10 aa, Artificial Sequence
  Description of Artificial Sequence: Synthetic peptide
TNIFSISPMG

SEQ ID NO: 19 - protein, 10 aa, Artificial Sequence
  Description of Artificial Sequence: Synthetic peptide
TNIFSRSPMG

SEQ ID NO: 20 - protein, 10 aa, Artificial Sequence
  Description of Artificial Sequence: Synthetic peptide
TNIESISPMG

SEQ ID NO: 21 - protein, 10 aa, Artificial Sequence
  Description of Artificial Sequence: Synthetic peptide
SNIFSISPMG

SEQ ID NO: 22 - protein, 10 aa, Artificial Sequence
  Description of Artificial Sequence: Synthetic peptide
TNIFSTSPMG

SEQ ID NO: 23 - protein, 10 aa, Artificial Sequence
  Description of Artificial Sequence: Synthetic peptide
TNIVSISPMG

SEQ ID NO: 24 - protein, 10 aa, Artificial Sequence
  Description of Artificial Sequence: Synthetic peptide
TNIESISPMG

SEQ ID NO: 25 - protein, 10 aa, Artificial Sequence
  Description of Artificial Sequence: Synthetic peptide
TNIPSISPMG

SEQ ID NO: 26 - protein, 10 aa, Artificial Sequence
  Description of Artificial Sequence: Synthetic peptide
TNIFSSSPMG

SEQ ID NO: 27 - protein, 10 aa, Artificial Sequence
  Description of Artificial Sequence: Synthetic peptide
TNIFSISPMG

SEQ ID NO: 28 - protein, 10 aa, Artificial Sequence
  Description of Artificial Sequence: Synthetic peptide
TNIFSIYPMG

SEQ ID NO: 29 - protein, 10 aa, Artificial Sequence
  Description of Artificial Sequence: Synthetic peptide
TNIFSNSPMG

SEQ ID NO: 30 - protein, 10 aa, Artificial Sequence
  Description of Artificial Sequence: Synthetic peptide
TNISSISPMG

SEQ ID NO: 31 - protein, 10 aa, Artificial Sequence
  Description of Artificial Sequence: Synthetic peptide
TNIVSISPMG

SEQ ID NO: 32 - protein, 10 aa, Artificial Sequence
  Description of Artificial Sequence: Synthetic peptide
TNIFSNSPMG

SEQ ID NO: 33 - protein, 10 aa, Artificial Sequence
  Description of Artificial Sequence: Synthetic peptide
TNITSISPMG

SEQ ID NO: 34 - protein, 10 aa, Artificial Sequence
  Description of Artificial Sequence: Synthetic peptide
TNIFSDSPMG

SEQ ID NO: 35 - protein, 10 aa, Artificial Sequence
  Description of Artificial Sequence: Synthetic peptide
TNIFSRSPMG

SEQ ID NO: 36 - protein, 10 aa, Artificial Sequence
  Description of Artificial Sequence: Synthetic peptide
TNIFSASPMG

SEQ ID NO: 37 - protein, 10 aa, Artificial Sequence
  Description of Artificial Sequence: Synthetic peptide
TNIFSASPMG

SEQ ID NO: 38 - protein, 10 aa, Artificial Sequence
  Description of Artificial Sequence: Synthetic peptide
TNITSISPMG

SEQ ID NO: 39 - protein, 10 aa, Artificial Sequence
  Description of Artificial Sequence: Synthetic peptide
TNIASISPMG

SEQ ID NO: 40 - protein, 10 aa, Artificial Sequence
  Description of Artificial Sequence: Synthetic peptide
TNIFSRSPMG

SEQ ID NO: 41 - protein, 10 aa, Artificial Sequence
  Description of Artificial Sequence: Synthetic peptide
TNIFSLSPMG

SEQ ID NO: 42 - protein, 10 aa, Artificial Sequence
  Description of Artificial Sequence: Synthetic peptide
TNIPSISPMG

SEQ ID NO: 43 - protein, 10 aa, Artificial Sequence
  Description of Artificial Sequence: Synthetic peptide
TNIFSQSPMG

SEQ ID NO: 44 - protein, 10 aa, Artificial Sequence
  Description of Artificial Sequence: Synthetic peptide
TNIESISPMG

SEQ ID NO: 45 - protein, 10 aa, Artificial Sequence
  Description of Artificial Sequence: Synthetic peptide
TNIFSHSPMG

SEQ ID NO: 46 - protein, 10 aa, Artificial Sequence
  Description of Artificial Sequence: Synthetic peptide
TNIFSESPMG

SEQ ID NO: 47 - protein, 10 aa, Artificial Sequence
  Description of Artificial Sequence: Synthetic peptide
TNIDSISPMG

SEQ ID NO: 48 - protein, 10 aa, Artificial Sequence
  Description of Artificial Sequence: Synthetic peptide
TNIFSSSPMG

SEQ ID NO: 49 - protein, 10 aa, Artificial Sequence
  Description of Artificial Sequence: Synthetic peptide
TNIFSTSPMG

SEQ ID NO: 50 - protein, 10 aa, Artificial Sequence
  Description of Artificial Sequence: Synthetic peptide
TNITSVSPMG

SEQ ID NO: 51 - protein, 10 aa, Artificial Sequence
  Description of Artificial Sequence: Synthetic peptide
TNISSISPMG

SEQ ID NO: 52 - protein, 10 aa, Artificial Sequence
  Description of Artificial Sequence: Synthetic peptide
SNIFSISPMG

SEQ ID NO: 53 - protein, 10 aa, Artificial Sequence
  Description of Artificial Sequence: Synthetic peptide
TNIFRISPMG

SEQ ID NO: 54 - protein, 10 aa, Artificial Sequence
  Description of Artificial Sequence: Synthetic peptide
TNIVSISPMG

SEQ ID NO: 55 - protein, 10 aa, Artificial Sequence
  Description of Artificial Sequence: Synthetic peptide
TNIDSISPMG

SEQ ID NO: 56 - protein, 10 aa, Artificial Sequence
  Description of Artificial Sequence: Synthetic peptide
TNIFSRSPMG

SEQ ID NO: 57 - protein, 10 aa, Artificial Sequence
  Description of Artificial Sequence: Synthetic peptide
TNIQSISPMG

SEQ ID NO: 58 - protein, 10 aa, Artificial Sequence
  Description of Artificial Sequence: Synthetic peptide
TNIFNISPMG

SEQ ID NO: 59 - protein, 10 aa, Artificial Sequence
  Description of Artificial Sequence: Synthetic peptide
TNEFSISPMG

SEQ ID NO: 60 - protein, 10 aa, Artificial Sequence
  Description of Artificial Sequence: Synthetic peptide
TNIPSISPMG

SEQ ID NO: 61 - protein, 10 aa, Artificial Sequence
  Description of Artificial Sequence: Synthetic peptide
TNIGSISPMG

SEQ ID NO: 62 - protein, 10 aa, Artificial Sequence
  Description of Artificial Sequence: Synthetic peptide
TNIFSKSPMG

SEQ ID NO: 63 - protein, 10 aa, Artificial Sequence
  Description of Artificial Sequence: Synthetic peptide
TNIFSITPMG

SEQ ID NO: 64 - protein, 10 aa, Artificial Sequence
  Description of Artificial Sequence: Synthetic peptide
TSDFSISPMG

SEQ ID NO: 65 - protein, 10 aa, Artificial Sequence
  Description of Artificial Sequence: Synthetic peptide
TNIMSISPMG

SEQ ID NO: 66 - protein, 10 aa, Artificial Sequence
  Description of Artificial Sequence: Synthetic peptide
TNIMSISPMG

SEQ ID NO: 67 - protein, 10 aa, Artificial Sequence
  Description of Artificial Sequence: Synthetic peptide
TNIPSISPMG

SEQ ID NO: 68 - protein, 10 aa, Artificial Sequence
  Description of Artificial Sequence: Synthetic peptide
TNIFSTSPMG

SEQ ID NO: 69 - protein, 10 aa, Artificial Sequence
  Description of Artificial Sequence: Synthetic peptide
TNIFSQSPMG

SEQ ID NO: 70 - protein, 10 aa, Artificial Sequence
  Description of Artificial Sequence: Synthetic peptide
TNIASISPMG

SEQ ID NO: 71 - protein, 10 aa, Artificial Sequence
  Description of Artificial Sequence: Synthetic peptide
TNIFSKSPMG

SEQ ID NO: 72 - protein, 10 aa, Artificial Sequence
  Description of Artificial Sequence: Synthetic peptide
TNIFSRSPMG

SEQ ID NO: 73 - protein, 10 aa, Artificial Sequence
  Description of Artificial Sequence: Synthetic peptide
TNHFSISPMG

SEQ ID NO: 74 - protein, 10 aa, Artificial Sequence
  Description of Artificial Sequence: Synthetic peptide
TNIFSNSPMG

SEQ ID NO: 75 - protein, 10 aa, Artificial Sequence
  Description of Artificial Sequence: Synthetic peptide
TNIFSTSPMG

SEQ ID NO: 76 - protein, 10 aa, Artificial Sequence
  Description of Artificial Sequence: Synthetic peptide
TNIFSISPYG

SEQ ID NO: 77 - protein, 10 aa, Artificial Sequence
  Description of Artificial Sequence: Synthetic peptide
TNIFSNSPMG

SEQ ID NO: 78 - protein, 10 aa, Artificial Sequence
  Description of Artificial Sequence: Synthetic peptide
TNIFSSSPMG

SEQ ID NO: 79 - protein, 10 aa, Artificial Sequence
  Description of Artificial Sequence: Synthetic peptide
TNIVSISPMG

SEQ ID NO: 80 - protein, 10 aa, Artificial Sequence
  Description of Artificial Sequence: Synthetic peptide
TNISSISPMG

SEQ ID NO: 81 - protein, 10 aa, Artificial Sequence
  Description of Artificial Sequence: Synthetic peptide
TNIISISPMG

SEQ ID NO: 82 - protein, 10 aa, Artificial Sequence
  Description of Artificial Sequence: Synthetic peptide
TNIASISPMG

SEQ ID NO: 83 - protein, 10 aa, Artificial Sequence
  Description of Artificial Sequence: Synthetic peptide
TNIFSESPMG

SEQ ID NO: 84 - protein, 10 aa, Artificial Sequence
  Description of Artificial Sequence: Synthetic peptide
TNIFSTSPMG

SEQ ID NO: 85 - protein, 10 aa, Artificial Sequence
  Description of Artificial Sequence: Synthetic peptide
TNISSISPMG

SEQ ID NO: 86 - protein, 10 aa, Artificial Sequence
  Description of Artificial Sequence: Synthetic peptide
TNVVSISPMG

SEQ ID NO: 87 - protein, 10 aa, Artificial Sequence
  Description of Artificial Sequence: Synthetic peptide
TNEFSISPMG

SEQ ID NO: 88 - protein, 10 aa, Artificial Sequence
  Description of Artificial Sequence: Synthetic peptide
TNIFSNSPMG

SEQ ID NO: 89 - protein, 10 aa, Artificial Sequence
  Description of Artificial Sequence: Synthetic peptide
TNIFSRSPMG

SEQ ID NO: 90 - protein, 10 aa, Artificial Sequence
  Description of Artificial Sequence: Synthetic peptide
TNIFSDSPMG

SEQ ID NO: 91 - protein, 10 aa, Artificial Sequence
  Description of Artificial Sequence: Synthetic peptide
TNDFSISPMG

SEQ ID NO: 92 - protein, 10 aa, Artificial Sequence
  Description of Artificial Sequence: Synthetic peptide
TNIFSKSPMG

SEQ ID NO: 93 - protein, 10 aa, Artificial Sequence
  Description of Artificial Sequence: Synthetic peptide
TNIFSIYPMG

SEQ ID NO: 94 - protein, 10 aa, Artificial Sequence
  Description of Artificial Sequence: Synthetic peptide
TNIFSSSPMG

SEQ ID NO: 95 - protein, 10 aa, Artificial Sequence
  Description of Artificial Sequence: Synthetic peptide
TNIFSVSPMG

SEQ ID NO: 96 - protein, 10 aa, Artificial Sequence
  Description of Artificial Sequence: Synthetic peptide
TNIFSITPMG

SEQ ID NO: 97 - protein, 10 aa, Artificial Sequence
  Description of Artificial Sequence: Synthetic peptide
TNIESISPMG

SEQ ID NO: 98 - protein, 10 aa, Artificial Sequence
  Description of Artificial Sequence: Synthetic peptide
TNIFSTSPMG

SEQ ID NO: 99 - protein, 10 aa, Artificial Sequence
  Description of Artificial Sequence: Synthetic peptide
TNIESISPMG

SEQ ID NO: 100 - protein, 10 aa, Artificial Sequence
  Description of Artificial Sequence: Synthetic peptide
TNIFSINPMG

SEQ ID NO: 101 - protein, 10 aa, Artificial Sequence
  Description of Artificial Sequence: Synthetic peptide
TNIFSITPMG

SEQ ID NO: 102 - protein, 10 aa, Artificial Sequence
  Description of Artificial Sequence: Synthetic peptide
TNITSISPMG

SEQ ID NO: 103 - protein, 10 aa, Artificial Sequence
  Description of Artificial Sequence: Synthetic peptide
TNIFSGSPMG

SEQ ID NO: 104 - protein, 10 aa, Artificial Sequence
  Description of Artificial Sequence: Synthetic peptide
TNIFSITPMG

SEQ ID NO: 105 - protein, 10 aa, Artificial Sequence
  Description of Artificial Sequence: Synthetic peptide
TNIDSISPMG

SEQ ID NO: 106 - protein, 10 aa, Artificial Sequence
  Description of Artificial Sequence: Synthetic peptide
TNIFSDSPMG

SEQ ID NO: 107 - protein, 10 aa, Artificial Sequence
  Description of Artificial Sequence: Synthetic peptide
TNIDSISPMG

SEQ ID NO: 108 - protein, 10 aa, Artificial Sequence
  Description of Artificial Sequence: Synthetic peptide
TNIFSKSPMG

SEQ ID NO: 109 - protein, 10 aa, Artificial Sequence
  Description of Artificial Sequence: Synthetic peptide
TNIFSVSPMG

SEQ ID NO: 110 - protein, 10 aa, Artificial Sequence
  Description of Artificial Sequence: Synthetic peptide
TNQFSISPMG

SEQ ID NO: 111 - protein, 10 aa, Artificial Sequence
  Description of Artificial Sequence: Synthetic peptide
TNIRSISPMG

SEQ ID NO: 112 - protein, 10 aa, Artificial Sequence
  Description of Artificial Sequence: Synthetic peptide
TNIFSRSPMG

SEQ ID NO: 113 - protein, 10 aa, Artificial Sequence
  Description of Artificial Sequence: Synthetic peptide
TNITSISPMG

SEQ ID NO: 114 - protein, 10 aa, Artificial Sequence
  Description of Artificial Sequence: Synthetic peptide
TNIFSTSPYG

SEQ ID NO: 115 - protein, 10 aa, Artificial Sequence
  Description of Artificial Sequence: Synthetic peptide
TNIFSTSPGG

SEQ ID NO: 116 - protein, 10 aa, Artificial Sequence
  Description of Artificial Sequence: Synthetic peptide
TNIFSITPYG

SEQ ID NO: 117 - protein, 10 aa, Artificial Sequence
  Description of Artificial Sequence: Synthetic peptide
TNIFSITPGG

SEQ ID NO: 118 - protein, 14 aa, Artificial Sequence
  Description of Artificial Sequence: Synthetic peptide
AIHGGSTLYADSVK

SEQ ID NO: 119 - protein, 14 aa, Artificial Sequence
  Description of Artificial Sequence: Synthetic peptide
AINGFSTLYADSVK

SEQ ID NO: 120 - protein, 14 aa, Artificial Sequence
  Description of Artificial Sequence: Synthetic peptide
AIHGSSTLYADSVK

SEQ ID NO: 121 - protein, 14 aa, Artificial Sequence
  Description of Artificial Sequence: Synthetic peptide
AIHGDSTLYADSVK

SEQ ID NO: 122 - protein, 14 aa, Artificial Sequence
  Description of Artificial Sequence: Synthetic peptide
AIHGFSTLYADSVK

SEQ ID NO: 123 - protein, 14 aa, Artificial Sequence
  Description of Artificial Sequence: Synthetic peptide
AIHGFSTVYADSVK

SEQ ID NO: 124 - protein, 14 aa, Artificial Sequence
  Description of Artificial Sequence: Synthetic peptide
AIHGTSTLYADSVK

SEQ ID NO: 125 - protein, 14 aa, Artificial Sequence
  Description of Artificial Sequence: Synthetic peptide
AIHGESTLYADSVK

SEQ ID NO: 126 - protein, 14 aa, Artificial Sequence
  Description of Artificial Sequence: Synthetic peptide
AIHGRSTLYADSVK

SEQ ID NO: 127 - protein, 14 aa, Artificial Sequence
  Description of Artificial Sequence: Synthetic peptide
AIHGESTLYADSVK

SEQ ID NO: 128 - protein, 14 aa, Artificial Sequence
  Description of Artificial Sequence: Synthetic peptide
AISGFSTLYADSVK

SEQ ID NO: 129 - protein, 14 aa, Artificial Sequence
  Description of Artificial Sequence: Synthetic peptide
AIHGKSTLYADSVK

SEQ ID NO: 130 - protein, 14 aa, Artificial Sequence
  Description of Artificial Sequence: Synthetic peptide
AIHGKSTLYADSVK

SEQ ID NO: 131 - protein, 14 aa, Artificial Sequence
  Description of Artificial Sequence: Synthetic peptide
AIHGFETLYADSVK

SEQ ID NO: 132 - protein, 14 aa, Artificial Sequence
  Description of Artificial Sequence: Synthetic peptide
AIHGDSTLYADSVK

SEQ ID NO: 133 - protein, 14 aa, Artificial Sequence
  Description of Artificial Sequence: Synthetic peptide
AIHGNSTLYADSVK

SEQ ID NO: 134 - protein, 14 aa, Artificial Sequence
  Description of Artificial Sequence: Synthetic peptide
AIHGSSTLYADSVK

SEQ ID NO: 135 - protein, 14 aa, Artificial Sequence
  Description of Artificial Sequence: Synthetic peptide
AIHGSSTLYADSVK

SEQ ID NO: 136 - protein, 14 aa, Artificial Sequence
  Description of Artificial Sequence: Synthetic peptide
AIHGFQTLYADSVK

SEQ ID NO: 137 - protein, 14 aa, Artificial Sequence
  Description of Artificial Sequence: Synthetic peptide
AIHGHSTLYADSVK

SEQ ID NO: 138 - protein, 14 aa, Artificial Sequence
  Description of Artificial Sequence: Synthetic peptide
AIHGNSTLYADSVK

SEQ ID NO: 139 - protein, 14 aa, Artificial Sequence
  Description of Artificial Sequence: Synthetic peptide
AIHGDSTLYADSVK

SEQ ID NO: 140 - protein, 14 aa, Artificial Sequence
  Description of Artificial Sequence: Synthetic peptide
AIHGFKTLYADSVK

SEQ ID NO: 141 - protein, 14 aa, Artificial Sequence
  Description of Artificial Sequence: Synthetic peptide
AIHGDSTLYADSVK

SEQ ID NO: 142 - protein, 14 aa, Artificial Sequence
  Description of Artificial Sequence: Synthetic peptide
AIHGFSTYYADSVK

SEQ ID NO: 143 - protein, 14 aa, Artificial Sequence
  Description of Artificial Sequence: Synthetic peptide
AIHGGSTLYADSVK

SEQ ID NO: 144 - protein, 14 aa, Artificial Sequence
  Description of Artificial Sequence: Synthetic peptide
AIHGFSTLYADSVK

SEQ ID NO: 145 - protein, 14 aa, Artificial Sequence
  Description of Artificial Sequence: Synthetic peptide
AIHGKSTLYADSVK

SEQ ID NO: 146 - protein, 14 aa, Artificial Sequence
  Description of Artificial Sequence: Synthetic peptide
AIHGDSTLYADSVK

SEQ ID NO: 147 - protein, 14 aa, Artificial Sequence
  Description of Artificial Sequence: Synthetic peptide
AIHGVSTLYADSVK

SEQ ID NO: 148 - protein, 14 aa, Artificial Sequence
  Description of Artificial Sequence: Synthetic peptide
AIHGTSTLYADSVK

SEQ ID NO: 149 - protein, 14 aa, Artificial Sequence
  Description of Artificial Sequence: Synthetic peptide
AIHGDSTLYADSVK

SEQ ID NO: 150 - protein, 14 aa, Artificial Sequence
  Description of Artificial Sequence: Synthetic peptide
AIHGSSTLYADSVK

SEQ ID NO: 151 - protein, 14 aa, Artificial Sequence
  Description of Artificial Sequence: Synthetic peptide
AIHGSSTLYADSVK

SEQ ID NO: 152 - protein, 14 aa, Artificial Sequence
  Description of Artificial Sequence: Synthetic peptide
AIHGDSTLYADSVK

SEQ ID NO: 153 - protein, 14 aa, Artificial Sequence
  Description of Artificial Sequence: Synthetic peptide
AIHGTSTLYADSVK

SEQ ID NO: 154 - protein, 14 aa, Artificial Sequence
  Description of Artificial Sequence: Synthetic peptide
AIHGTSTLYADSVK

SEQ ID NO: 155 - protein, 14 aa, Artificial Sequence
  Description of Artificial Sequence: Synthetic peptide
AIHGDSTLYADSVK

SEQ ID NO: 156 - protein, 14 aa, Artificial Sequence
  Description of Artificial Sequence: Synthetic peptide
AIHGQSTLYADSVK

SEQ ID NO: 157 - protein, 14 aa, Artificial Sequence
  Description of Artificial Sequence: Synthetic peptide
AIHGDSTLYADSVK

SEQ ID NO: 158 - protein, 14 aa, Artificial Sequence
  Description of Artificial Sequence: Synthetic peptide
AIHGKSTLYADSVK

SEQ ID NO: 159 - protein, 14 aa, Artificial Sequence
  Description of Artificial Sequence: Synthetic peptide
AIHGTSTLYADSVK

SEQ ID NO: 160 - protein, 14 aa, Artificial Sequence
  Description of Artificial Sequence: Synthetic peptide
AIHGNSTLYADSVK

SEQ ID NO: 161 - protein, 14 aa, Artificial Sequence
  Description of Artificial Sequence: Synthetic peptide
AIHGFQTLYADSVK

SEQ ID NO: 162 - protein, 14 aa, Artificial Sequence
  Description of Artificial Sequence: Synthetic peptide
AIHGFSTWYADSVK

SEQ ID NO: 163 - protein, 14 aa, Artificial Sequence
  Description of Artificial Sequence: Synthetic peptide
AIHGFSTIYADSVK

SEQ ID NO: 164 - protein, 14 aa, Artificial Sequence
  Description of Artificial Sequence: Synthetic peptide
AIHGPSTLYADSVK

SEQ ID NO: 165 - protein, 14 aa, Artificial Sequence
  Description of Artificial Sequence: Synthetic peptide
AIHGHSTLYADSVK

SEQ ID NO: 166 - protein, 14 aa, Artificial Sequence
  Description of Artificial Sequence: Synthetic peptide
AIHGESTLYADSVK

SEQ ID NO: 167 - protein, 14 aa, Artificial Sequence
  Description of Artificial Sequence: Synthetic peptide
AIHGDSTLYADSVK

SEQ ID NO: 168 - protein, 14 aa, Artificial Sequence
  Description of Artificial Sequence: Synthetic peptide
AIHGDSTLYADSVK

SEQ ID NO: 169 - protein, 14 aa, Artificial Sequence
  Description of Artificial Sequence: Synthetic peptide
AIHGNSTLYADSVK

SEQ ID NO: 170 - protein, 14 aa, Artificial Sequence
  Description of Artificial Sequence: Synthetic peptide
AIHGFETLYADSVK

SEQ ID NO: 171 - protein, 14 aa, Artificial Sequence
  Description of Artificial Sequence: Synthetic peptide
AIHGFETLYADSVK

SEQ ID NO: 172 - protein, 14 aa, Artificial Sequence
  Description of Artificial Sequence: Synthetic peptide
AIHGFSTYYADSVK

SEQ ID NO: 173 - protein, 14 aa, Artificial Sequence
  Description of Artificial Sequence: Synthetic peptide
AIHGLSTLYADSVK

SEQ ID NO: 174 - protein, 14 aa, Artificial Sequence
  Description of Artificial Sequence: Synthetic peptide
AIHGASTLYADSVK

SEQ ID NO: 175 - protein, 14 aa, Artificial Sequence
  Description of Artificial Sequence: Synthetic peptide
AIHGQSTLYADSVK

SEQ ID NO: 176 - protein, 14 aa, Artificial Sequence
  Description of Artificial Sequence: Synthetic peptide
AIHGQSTLYADSVK

SEQ ID NO: 177 - protein, 14 aa, Artificial Sequence
  Description of Artificial Sequence: Synthetic peptide
AIHGTSTLYADSVK

SEQ ID NO: 178 - protein, 14 aa, Artificial Sequence
  Description of Artificial Sequence: Synthetic peptide
AIHGFETLYADSVK

SEQ ID NO: 179 - protein, 14 aa, Artificial Sequence
  Description of Artificial Sequence: Synthetic peptide
AIHGFSTVYADSVK

SEQ ID NO: 180 - protein, 14 aa, Artificial Sequence
  Description of Artificial Sequence: Synthetic peptide
AIHGNSTLYADSVK

SEQ ID NO: 181 - protein, 14 aa, Artificial Sequence
  Description of Artificial Sequence: Synthetic peptide
AIHGESTLYADSVK

SEQ ID NO: 182 - protein, 14 aa, Artificial Sequence
  Description of Artificial Sequence: Synthetic peptide
AIHGFSTLYADSVK

SEQ ID NO: 183 - protein, 14 aa, Artificial Sequence
  Description of Artificial Sequence: Synthetic peptide
AIHGKSTLYADSVK

SEQ ID NO: 184 - protein, 14 aa, Artificial Sequence
  Description of Artificial Sequence: Synthetic peptide
AIHGKSTLYADSVK

SEQ ID NO: 185 - protein, 14 aa, Artificial Sequence
  Description of Artificial Sequence: Synthetic peptide
AIHGNSTLYADSVK

SEQ ID NO: 186 - protein, 14 aa, Artificial Sequence
  Description of Artificial Sequence: Synthetic peptide
AIHGESTLYADSVK

SEQ ID NO: 187 - protein, 14 aa, Artificial Sequence
  Description of Artificial Sequence: Synthetic peptide
AIHGSSTLYADSVK

SEQ ID NO: 188 - protein, 14 aa, Artificial Sequence
  Description of Artificial Sequence: Synthetic peptide
AIHGRSTLYADSVK

SEQ ID NO: 189 - protein, 14 aa, Artificial Sequence
  Description of Artificial Sequence: Synthetic peptide
AIHGFSTIYADSVK

SEQ ID NO: 190 - protein, 14 aa, Artificial Sequence
  Description of Artificial Sequence: Synthetic peptide
AIHGTSTLYADSVK

SEQ ID NO: 191 - protein, 14 aa, Artificial Sequence
  Description of Artificial Sequence: Synthetic peptide
AIHGFSTLYADSVK

SEQ ID NO: 192 - protein, 14 aa, Artificial Sequence
  Description of Artificial Sequence: Synthetic peptide
AIHGHSTLYADSVK

SEQ ID NO: 193 - protein, 14 aa, Artificial Sequence
  Description of Artificial Sequence: Synthetic peptide
AIHGDSTLYADSVK

SEQ ID NO: 194 - protein, 14 aa, Artificial Sequence
  Description of Artificial Sequence: Synthetic peptide
AIHGFDTLYADSVK

SEQ ID NO: 195 - protein, 14 aa, Artificial Sequence
  Description of Artificial Sequence: Synthetic peptide
AIHGASTLYADSVK

SEQ ID NO: 196 - protein, 14 aa, Artificial Sequence
  Description of Artificial Sequence: Synthetic peptide
AIHGSSTLYADSVK

SEQ ID NO: 197 - protein, 14 aa, Artificial Sequence
  Description of Artificial Sequence: Synthetic peptide
AIHGFTTLYADSVK

SEQ ID NO: 198 - protein, 14 aa, Artificial Sequence
  Description of Artificial Sequence: Synthetic peptide
AIHGTSTLYADSVK

SEQ ID NO: 199 - protein, 14 aa, Artificial Sequence
  Description of Artificial Sequence: Synthetic peptide
AIHGFSTVYADSVK

SEQ ID NO: 200 - protein, 14 aa, Artificial Sequence
  Description of Artificial Sequence: Synthetic peptide
AIHGKSTLYADSVK

SEQ ID NO: 201 - protein, 14 aa, Artificial Sequence
  Description of Artificial Sequence: Synthetic peptide
AIHGESTLYADSVK

SEQ ID NO: 202 - protein, 14 aa, Artificial Sequence
  Description of Artificial Sequence: Synthetic peptide
AIHGPSTLYADSVK

SEQ ID NO: 203 - protein, 14 aa, Artificial Sequence
  Description of Artificial Sequence: Synthetic peptide
AIHGISTLYADSVK

SEQ ID NO: 204 - protein, 14 aa, Artificial Sequence
  Description of Artificial Sequence: Synthetic peptide
AIHGFSTFYADSVK

SEQ ID NO: 205 - protein, 14 aa, Artificial Sequence
  Description of Artificial Sequence: Synthetic peptide
AIHGGSTLYADSVK

SEQ ID NO: 206 - protein, 14 aa, Artificial Sequence
  Description of Artificial Sequence: Synthetic peptide
AIHGSSTLYADSVK

SEQ ID NO: 207 - protein, 14 aa, Artificial Sequence
  Description of Artificial Sequence: Synthetic peptide
AIHGSSTLYADSVK

SEQ ID NO: 208 - protein, 14 aa, Artificial Sequence
  Description of Artificial Sequence: Synthetic peptide
AIHGFSTLYADSVK

SEQ ID NO: 209 - protein, 14 aa, Artificial Sequence
  Description of Artificial Sequence: Synthetic peptide
AIHGNSTLYADSVK

SEQ ID NO: 210 - protein, 14 aa, Artificial Sequence
  Description of Artificial Sequence: Synthetic peptide
AIHGESTLYADSVK

SEQ ID NO: 211 - protein, 14 aa, Artificial Sequence
  Description of Artificial Sequence: Synthetic peptide
AIHGFSTLYADSVK

SEQ ID NO: 212 - protein, 14 aa, Artificial Sequence
  Description of Artificial Sequence: Synthetic peptide
AIHGTSTLYADSVK

SEQ ID NO: 213 - protein, 14 aa, Artificial Sequence
  Description of Artificial Sequence: Synthetic peptide
AIHGTSTLYADSVK

SEQ ID NO: 214 - protein, 14 aa, Artificial Sequence
  Description of Artificial Sequence: Synthetic peptide
AIHGFDTLYADSVK

SEQ ID NO: 215 - protein, 14 aa, Artificial Sequence
  Description of Artificial Sequence: Synthetic peptide
AIHGASTLYADSVK

SEQ ID NO: 216 - protein, 14 aa, Artificial Sequence
  Description of Artificial Sequence: Synthetic peptide
AIHGNSTLYADSVK

SEQ ID NO: 217 - protein, 14 aa, Artificial Sequence
  Description of Artificial Sequence: Synthetic peptide
AIHGNSTLYADSVK

SEQ ID NO: 218 - protein, 14 aa, Artificial Sequence
  Description of Artificial Sequence: Synthetic peptide
AIHGESTLYADSVK

SEQ ID NO: 219 - protein, 14 aa, Artificial Sequence
  Description of Artificial Sequence: Synthetic peptide
AIHGESTLYADSVK

SEQ ID NO: 220 - protein, 14 aa, Artificial Sequence
  Description of Artificial Sequence: Synthetic peptide
AIHGFSTLYADSVK

SEQ ID NO: 221 - protein, 14 aa, Artificial Sequence
  Description of Artificial Sequence: Synthetic peptide
AIHGSSTLYADSVK

SEQ ID NO: 222 - protein, 14 aa, Artificial Sequence
  Description of Artificial Sequence: Synthetic peptide
AIHGSSTLYADSVK

SEQ ID NO: 223 - protein, 14 aa, Artificial Sequence
  Description of Artificial Sequence: Synthetic peptide
AIHGNSTLYADSVK

SEQ ID NO: 224 - protein, 14 aa, Artificial Sequence
  Description of Artificial Sequence: Synthetic peptide
AIHGKSTLYADSVK

SEQ ID NO: 225 - protein, 14 aa, Artificial Sequence
  Description of Artificial Sequence: Synthetic peptide
AIHGSSTLYADSVK

SEQ ID NO: 226 - protein, 14 aa, Artificial Sequence
  Description of Artificial Sequence: Synthetic peptide
AIHGSSTLYADSVK

SEQ ID NO: 227 - protein, 14 aa, Artificial Sequence
  Description of Artificial Sequence: Synthetic peptide
AIHGESTLYADSVK

SEQ ID NO: 228 - protein, 14 aa, Artificial Sequence
  Description of Artificial Sequence: Synthetic peptide
AIHGFSTIYADSVK

SEQ ID NO: 229 - protein, 14 aa, Artificial Sequence
  Description of Artificial Sequence: Synthetic peptide
AIHGFSTIYADSVK

SEQ ID NO: 230 - protein, 14 aa, Artificial Sequence
  Description of Artificial Sequence: Synthetic peptide
AIHGASTLYADSVK

SEQ ID NO: 231 - protein, 14 aa, Artificial Sequence
  Description of Artificial Sequence: Synthetic peptide
AIHGASTLYADSVK

SEQ ID NO: 232 - protein, 12 aa, Artificial Sequence
  Description of Artificial Sequence: Synthetic peptide
VPWGDYHPRNVA

SEQ ID NO: 233 - protein, 12 aa, Artificial Sequence
  Description of Artificial Sequence: Synthetic peptide
VPWGDYHPRNVH

SEQ ID NO: 234 - protein, 12 aa, Artificial Sequence
  Description of Artificial Sequence: Synthetic peptide
VPWGDYHPRNVY

SEQ ID NO: 235 - protein, 12 aa, Artificial Sequence
  Description of Artificial Sequence: Synthetic peptide
VPWGRYHPRNVY

SEQ ID NO: 236 - protein, 12 aa, Artificial Sequence
  Description of Artificial Sequence: Synthetic peptide
VPWGDYHPRNVY

SEQ ID NO: 237 - protein, 12 aa, Artificial Sequence
  Description of Artificial Sequence: Synthetic peptide
VPWGDYHPRNVY

SEQ ID NO: 238 - protein, 12 aa, Artificial Sequence
  Description of Artificial Sequence: Synthetic peptide
VPWGDYHPGNVY

SEQ ID NO: 239 - protein, 12 aa, Artificial Sequence
  Description of Artificial Sequence: Synthetic peptide
VPWGDYHPRKVY

SEQ ID NO: 240 - protein, 12 aa, Artificial Sequence
  Description of Artificial Sequence: Synthetic peptide
VPWGSYHPRNVY

SEQ ID NO: 241 - protein, 12 aa, Artificial Sequence
  Description of Artificial Sequence: Synthetic peptide
VPWGDYHPRNVA

SEQ ID NO: 242 - protein, 12 aa, Artificial Sequence
  Description of Artificial Sequence: Synthetic peptide
VPWGDYHPRNVY

SEQ ID NO: 243 - protein, 12 aa, Artificial Sequence
  Description of Artificial Sequence: Synthetic peptide
VPWGDYHPRNVV

SEQ ID NO: 244 - protein, 12 aa, Artificial Sequence
  Description of Artificial Sequence: Synthetic peptide
VPWGDYHPRNVK

SEQ ID NO: 245 - protein, 12 aa, Artificial Sequence
  Description of Artificial Sequence: Synthetic peptide
VPWGDYHPGNVY

SEQ ID NO: 246 - protein, 12 aa, Artificial Sequence
  Description of Artificial Sequence: Synthetic peptide
VPWGEYHPRNVY

SEQ ID NO: 247 - protein, 12 aa, Artificial Sequence
  Description of Artificial Sequence: Synthetic peptide
VPWGIYHPRNVY

SEQ ID NO: 248 - protein, 12 aa, Artificial Sequence
  Description of Artificial Sequence: Synthetic peptide
VPWGRYHPRNVY

SEQ ID NO: 249 - protein, 12 aa, Artificial Sequence
  Description of Artificial Sequence: Synthetic peptide
VPWGDYHPGNVY

SEQ ID NO: 250 - protein, 12 aa, Artificial Sequence
  Description of Artificial Sequence: Synthetic peptide
VPWGDYHPRNVV

SEQ ID NO: 251 - protein, 12 aa, Artificial Sequence
  Description of Artificial Sequence: Synthetic peptide
VPWGDYHPGNVY

SEQ ID NO: 252 - protein, 12 aa, Artificial Sequence
  Description of Artificial Sequence: Synthetic peptide
VPWGRYHPRNVY

SEQ ID NO: 253 - protein, 12 aa, Artificial Sequence
  Description of Artificial Sequence: Synthetic peptide
VPWGDYHPRNVY

SEQ ID NO: 254 - protein, 12 aa, Artificial Sequence
  Description of Artificial Sequence: Synthetic peptide
VPWGDYHPGNVY

SEQ ID NO: 255 - protein, 12 aa, Artificial Sequence
  Description of Artificial Sequence: Synthetic peptide
VPWGKYHPRNVY

SEQ ID NO: 256 - protein, 12 aa, Artificial Sequence
  Description of Artificial Sequence: Synthetic peptide
VPWGSYHPRNVY

SEQ ID NO: 257 - protein, 12 aa, Artificial Sequence
  Description of Artificial Sequence: Synthetic peptide
VPWGDYHPRNVH

SEQ ID NO: 258 - protein, 12 aa, Artificial Sequence
  Description of Artificial Sequence: Synthetic peptide
VPWGYYHPRNVY

SEQ ID NO: 259 - protein, 12 aa, Artificial Sequence
  Description of Artificial Sequence: Synthetic peptide
VPWGDYHPGNVY

SEQ ID NO: 260 - protein, 12 aa, Artificial Sequence
  Description of Artificial Sequence: Synthetic peptide
VPWGDYHPRNVR

SEQ ID NO: 261 - protein, 12 aa, Artificial Sequence
  Description of Artificial Sequence: Synthetic peptide
VPWGDYHPRNVQ

SEQ ID NO: 262 - protein, 12 aa, Artificial Sequence
  Description of Artificial Sequence: Synthetic peptide
VPWGDYHPRNVY

SEQ ID NO: 263 - protein, 12 aa, Artificial Sequence
  Description of Artificial Sequence: Synthetic peptide
VPWGDYHPRNVT

SEQ ID NO: 264 - protein, 12 aa, Artificial Sequence
  Description of Artificial Sequence: Synthetic peptide
VPWGDYHPRNVN

SEQ ID NO: 265 - protein, 12 aa, Artificial Sequence
  Description of Artificial Sequence: Synthetic peptide
VPWGRYHPRNVY

SEQ ID NO: 266 - protein, 12 aa, Artificial Sequence
  Description of Artificial Sequence: Synthetic peptide
VPWGDYHPGNVY

SEQ ID NO: 267 - protein, 12 aa, Artificial Sequence
  Description of Artificial Sequence: Synthetic peptide
VPWGDYHPGNVY

SEQ ID NO: 268 - protein, 12 aa, Artificial Sequence
  Description of Artificial Sequence: Synthetic peptide
VPWGKYHPRNVY

SEQ ID NO: 269 - protein, 12 aa, Artificial Sequence
  Description of Artificial Sequence: Synthetic peptide
VPWGDYHPRNVY

SEQ ID NO: 270 - protein, 12 aa, Artificial Sequence
  Description of Artificial Sequence: Synthetic peptide
VPWGDYHPRNVQ

SEQ ID NO: 271 - protein, 12 aa, Artificial Sequence
  Description of Artificial Sequence: Synthetic peptide
VPWGDYHPGNVC

SEQ ID NO: 272 - protein, 12 aa, Artificial Sequence
  Description of Artificial Sequence: Synthetic peptide
VPWGDYHPRRVY

SEQ ID NO: 273 - protein, 12 aa, Artificial Sequence
  Description of Artificial Sequence: Synthetic peptide
VPWGRYHPRNVY

SEQ ID NO: 274 - protein, 12 aa, Artificial Sequence
  Description of Artificial Sequence: Synthetic peptide
VPWGTYHPRNVY

SEQ ID NO: 275 - protein, 12 aa, Artificial Sequence
  Description of Artificial Sequence: Synthetic peptide
VPWGDYHPGNVY

SEQ ID NO: 276 - protein, 12 aa, Artificial Sequence
  Description of Artificial Sequence: Synthetic peptide
VPWGRYHPRNVY

SEQ ID NO: 277 - protein, 12 aa, Artificial Sequence
  Description of Artificial Sequence: Synthetic peptide
VPWGDYHPGNVY

SEQ ID NO: 278 - protein, 12 aa, Artificial Sequence
  Description of Artificial Sequence: Synthetic peptide
VPWGDYHPTNVY

SEQ ID NO: 279 - protein, 12 aa, Artificial Sequence
  Description of Artificial Sequence: Synthetic peptide
VPWGRYHPRNVY

SEQ ID NO: 280 - protein, 12 aa, Artificial Sequence
  Description of Artificial Sequence: Synthetic peptide
VPWGDYHPRNVT

SEQ ID NO: 281 - protein, 12 aa, Artificial Sequence
  Description of Artificial Sequence: Synthetic peptide
VPWGRYHPRNVY

SEQ ID NO: 282 - protein, 12 aa, Artificial Sequence
  Description of Artificial Sequence: Synthetic peptide
VPWGDYHPRRVY

SEQ ID NO: 283 - protein, 12 aa, Artificial Sequence
  Description of Artificial Sequence: Synthetic peptide
VPWGDYHPRMVY

SEQ ID NO: 284 - protein, 12 aa, Artificial Sequence
  Description of Artificial Sequence: Synthetic peptide
VPWGDYHPRNVL

SEQ ID NO: 285 - protein, 12 aa, Artificial Sequence
  Description of Artificial Sequence: Synthetic peptide
VPWGDYHPGNVY

SEQ ID NO: 286 - protein, 12 aa, Artificial Sequence
  Description of Artificial Sequence: Synthetic peptide
VPWGRYHPRNVY

SEQ ID NO: 287 - protein, 12 aa, Artificial Sequence
  Description of Artificial Sequence: Synthetic peptide
VPWGAYHPRNVY

SEQ ID NO: 288 - protein, 12 aa, Artificial Sequence
  Description of Artificial Sequence: Synthetic peptide
VPWGDYHPRNVA

SEQ ID NO: 289 - protein, 12 aa, Artificial Sequence
  Description of Artificial Sequence: Synthetic peptide
VPWGDYHPQNVY

SEQ ID NO: 290 - protein, 12 aa, Artificial Sequence
  Description of Artificial Sequence: Synthetic peptide
VPWGDYHPRNVT

SEQ ID NO: 291 - protein, 12 aa, Artificial Sequence
  Description of Artificial Sequence: Synthetic peptide
VPWGRYHPRNVY

SEQ ID NO: 292 - protein, 12 aa, Artificial Sequence
  Description of Artificial Sequence: Synthetic peptide
VPWGDYHPGNVY

SEQ ID NO: 293 - protein, 12 aa, Artificial Sequence
  Description of Artificial Sequence: Synthetic peptide
VPWGDYHPGNVY

SEQ ID NO: 294 - protein, 12 aa, Artificial Sequence
  Description of Artificial Sequence: Synthetic peptide
VPWGDYHPGNVY

SEQ ID NO: 295 - protein, 12 aa, Artificial Sequence
  Description of Artificial Sequence: Synthetic peptide
VPWGDYHPRNVY

SEQ ID NO: 296 - protein, 12 aa, Artificial Sequence
  Description of Artificial Sequence: Synthetic peptide
VPWGDYHPGNVY

SEQ ID NO: 297 - protein, 12 aa, Artificial Sequence
  Description of Artificial Sequence: Synthetic peptide
VPWGDYHPSNVY

SEQ ID NO: 298 - protein, 12 aa, Artificial Sequence
  Description of Artificial Sequence: Synthetic peptide
VPWGDYHPGNVY

SEQ ID NO: 299 - protein, 12 aa, Artificial Sequence
  Description of Artificial Sequence: Synthetic peptide
VPWGDYHPREVY

SEQ ID NO: 300 - protein, 12 aa, Artificial Sequence
  Description of Artificial Sequence: Synthetic peptide
VPWGRYHPGNVY

SEQ ID NO: 301 - protein, 12 aa, Artificial Sequence
  Description of Artificial Sequence: Synthetic peptide
VPWGDYHPRVVY

SEQ ID NO: 302 - protein, 12 aa, Artificial Sequence
  Description of Artificial Sequence: Synthetic peptide
VPWGDYHPRNVM

SEQ ID NO: 303 - protein, 12 aa, Artificial Sequence
  Description of Artificial Sequence: Synthetic peptide
VPWGDYHPLNVY

SEQ ID NO: 304 - protein, 12 aa, Artificial Sequence
  Description of Artificial Sequence: Synthetic peptide
VPWGDYHPGNVY

SEQ ID NO: 305 - protein, 12 aa, Artificial Sequence
  Description of Artificial Sequence: Synthetic peptide
VPWGDYHPGNVY

SEQ ID NO: 306 - protein, 12 aa, Artificial Sequence
  Description of Artificial Sequence: Synthetic peptide
VPWGDYHPRNVT

SEQ ID NO: 307 - protein, 12 aa, Artificial Sequence
  Description of Artificial Sequence: Synthetic peptide
VPWGDYHPRNVS

SEQ ID NO: 308 - protein, 12 aa, Artificial Sequence
  Description of Artificial Sequence: Synthetic peptide
VPWGDYHPRNVY

SEQ ID NO: 309 - protein, 12 aa, Artificial Sequence
  Description of Artificial Sequence: Synthetic peptide
VPWGDYHPGNVY

SEQ ID NO: 310 - protein, 12 aa, Artificial Sequence
  Description of Artificial Sequence: Synthetic peptide
VPWGDYHPGNVY

SEQ ID NO: 311 - protein, 12 aa, Artificial Sequence
  Description of Artificial Sequence: Synthetic peptide
VPWGDYHPRNVT

SEQ ID NO: 312 - protein, 12 aa, Artificial Sequence
  Description of Artificial Sequence: Synthetic peptide
VPWGDYHPGNVY

SEQ ID NO: 313 - protein, 12 aa, Artificial Sequence
  Description of Artificial Sequence: Synthetic peptide
VPWGRYHPRNVY

SEQ ID NO: 314 - protein, 12 aa, Artificial Sequence
  Description of Artificial Sequence: Synthetic peptide
VPWGDYHPNNVY

SEQ ID NO: 315 - protein, 12 aa, Artificial Sequence
  Description of Artificial Sequence: Synthetic peptide
VPWGDYHPGNVY

SEQ ID NO: 316 - protein, 12 aa, Artificial Sequence
  Description of Artificial Sequence: Synthetic peptide
VPWGDYHPRNVT

SEQ ID NO: 317 - protein, 12 aa, Artificial Sequence
  Description of Artificial Sequence: Synthetic peptide
VPWGDYHPGNVY

SEQ ID NO: 318 - protein, 12 aa, Artificial Sequence
  Description of Artificial Sequence: Synthetic peptide
VPWGDYHPGNVY

SEQ ID NO: 319 - protein, 12 aa, Artificial Sequence
  Description of Artificial Sequence: Synthetic peptide
VPWGDYHPRNVA

SEQ ID NO: 320 - protein, 12 aa, Artificial Sequence
  Description of Artificial Sequence: Synthetic peptide
VPWGDYHPGNVY

SEQ ID NO: 321 - protein, 12 aa, Artificial Sequence
  Description of Artificial Sequence: Synthetic peptide
VPWGDYHPKNVY

SEQ ID NO: 322 - protein, 12 aa, Artificial Sequence
  Description of Artificial Sequence: Synthetic peptide
VPWGDYHPGNVY

SEQ ID NO: 323 - protein, 12 aa, Artificial Sequence
  Description of Artificial Sequence: Synthetic peptide
VPWGKYHPRNVY

SEQ ID NO: 324 - protein, 12 aa, Artificial Sequence
  Description of Artificial Sequence: Synthetic peptide
VPWGRYHPRNVY

SEQ ID NO: 325 - protein, 12 aa, Artificial Sequence
  Description of Artificial Sequence: Synthetic peptide
VPWGDYHPGNVY

SEQ ID NO: 326 - protein, 12 aa, Artificial Sequence
  Description of Artificial Sequence: Synthetic peptide
VPWGDYHPRNVQ

SEQ ID NO: 327 - protein, 12 aa, Artificial Sequence
  Description of Artificial Sequence: Synthetic peptide
VPWGDYHPGNVY

SEQ ID NO: 328 - protein, 12 aa, Artificial Sequence
  Description of Artificial Sequence: Synthetic peptide
VPWGDYHPRNVS

SEQ ID NO: 329 - protein, 12 aa, Artificial Sequence
  Description of Artificial Sequence: Synthetic peptide
VPWGDYHPGNVY

SEQ ID NO: 330 - protein, 12 aa, Artificial Sequence
  Description of Artificial Sequence: Synthetic peptide
VPWGDYHPGNVY

SEQ ID NO: 331 - protein, 12 aa, Artificial Sequence
  Description of Artificial Sequence: Synthetic peptide
VPWGDYHPGNVY

SEQ ID NO: 332 - protein, 12 aa, Artificial Sequence
  Description of Artificial Sequence: Synthetic peptide
VPWGDYHPRDVY

SEQ ID NO: 333 - protein, 12 aa, Artificial Sequence
  Description of Artificial Sequence: Synthetic peptide
VPWGDYHPRNVT

SEQ ID NO: 334 - protein, 12 aa, Artificial Sequence
  Description of Artificial Sequence: Synthetic peptide
VPWGDYHPRNVA

SEQ ID NO: 335 - protein, 12 aa, Artificial Sequence
  Description of Artificial Sequence: Synthetic peptide
VPWGDYHPRNVT

SEQ ID NO: 336 - protein, 12 aa, Artificial Sequence
  Description of Artificial Sequence: Synthetic peptide
VPWGDYHPRNVY

SEQ ID NO: 337 - protein, 12 aa, Artificial Sequence
  Description of Artificial Sequence: Synthetic peptide
VPWGDYHPRNVY

SEQ ID NO: 338 - protein, 12 aa, Artificial Sequence
  Description of Artificial Sequence: Synthetic peptide
VPWGDYHPRNVV

SEQ ID NO: 339 - protein, 12 aa, Artificial Sequence
  Description of Artificial Sequence: Synthetic peptide
VPWGDYHPRNVV

SEQ ID NO: 340 - protein, 12 aa, Artificial Sequence
  Description of Artificial Sequence: Synthetic peptide
VPWGDYHPGNVY

SEQ ID NO: 341 - protein, 12 aa, Artificial Sequence
  Description of Artificial Sequence: Synthetic peptide
VPWGDYHPRNVY

SEQ ID NO: 342 - protein, 12 aa, Artificial Sequence
  Description of Artificial Sequence: Synthetic peptide
VPWGDYHPGNVY

SEQ ID NO: 343 - protein, 12 aa, Artificial Sequence
  Description of Artificial Sequence: Synthetic peptide
VPWGDYHPGNVY

SEQ ID NO: 344 - protein, 12 aa, Artificial Sequence
  Description of Artificial Sequence: Synthetic peptide
VPWGDYHPGNVY

SEQ ID NO: 345 - protein, 12 aa, Artificial Sequence
  Description of Artificial Sequence: Synthetic peptide
VPWGDYHPGNVY

SEQ ID NO: 346 - protein, 119 aa, Artificial Sequence
  Description of Artificial Sequence: Synthetic polypeptide
EVQLVESGGGLVQPGRSLTLSCAASTNIFSISPMGWYRQAPGKQRELVAAIHGFSTLYADSVKGRFTISRDNAKNSIYLQMNSLRPEDTALYYCNKVPWGDYHPRNVYWGQGTQVTVSS

SEQ ID NO: 347 - protein, 119 aa, Artificial Sequence
  Description of Artificial Sequence: Synthetic polypeptide
EVQLVESGGGLVQPGRSLTLSCAASTDIFSISPMGWYRQAPGKQRELVAAIHGGSTLYADSVKGRFTISRDNAKNSIYLQMNSLRPEDTALYYCNKVPWGDYHPRNVAWGQGTQVTVSS

SEQ ID NO: 348 - protein, 119 aa, Artificial Sequence
  Description of Artificial Sequence: Synthetic polypeptide
EVQLVESGGGLVQPGRSLTLSCAASTNDFSISPMGWYRQAPGKQRELVAAIHGGSTLYADSVKGRFTISRDNAKNSIYLQMNSLRPEDTALYYCNKVPWGDYHPRNVAWGQGTQVTVSS

SEQ ID NO: 349 - protein, 119 aa, Artificial Sequence
  Description of Artificial Sequence: Synthetic polypeptide
EVQLVESGGGLVQPGRSLTLSCAASTNIFSKSPMGWYRQAPGKQRELVAAIHGKSTLYADSVKGRFTISRDNAKNSIYLQMNSLRPEDTALYYCNKVPWGDYHPRNVVWGQGTQVTVSS

SEQ ID NO: 350 - protein, 119 aa, Artificial Sequence
  Description of Artificial Sequence: Synthetic polypeptide
EVQLVESGGGLVQPGRSLTLSCAASTNDFSISPMGWYRQAPGKQRELVAAIHGKSTLYADSVKGRFTISRDNAKNSIYLQMNSLRPEDTALYYCNKVPWGDYHPRNVKWGQGTQVTVSS

SEQ ID NO: 351 - protein, 119 aa, Artificial Sequence
  Description of Artificial Sequence: Synthetic polypeptide
EVQLVESGGGLVQPGRSLTLSCAASTNQFSISPMGWYRQAPGKQRELVAAIHGKSTLYADSVKGRFTISRDNAKNSIYLQMNSLRPEDTALYYCNKVPWGDYHPRNVVWGQGTQVTVSS

SEQ ID NO: 352 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAINGFSTLYADSVKGRFTISRDNAKNSIYLQMNSLRPEDTALYYCNKVPWGDYHPRNVHWGQGTQVTVSS

SEQ ID NO: 353 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGFSTLYADSVKGRFTISRDNAKNSIYLQMNSLRPEDTALYYCNKVPWGDYHPRNVYWGQGTQVTVSS

SEQ ID NO: 354 - protein, 119 aa, Artificial Sequence
  Description of Artificial Sequence: Synthetic polypeptide
EVQLVESGGGLVQPGRSLTLSCAASTNIFSTSPMGWYRQAPGKQRELVAAIHGFQTLYADSVKGRFTISRDNAKNSIYLQMNSLRPEDTALYYCNKVPWGDYHPRNVVWGQGTQVTVSS

SEQ ID NO: 355 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGFETLYADSVKGRFTISRDNAKNSIYLQMNSLRPEDTALYYCNKVPWGDYHPRNVLWGQGTQVTVSS

SEQ ID NO: 356 - protein, 119 aa, Artificial Sequence
  Description of Artificial Sequence: Synthetic polypeptide
EVQLVESGGGLVQPGRSLTLSCAASTNIFSESPMGWYRQAPGKQRELVAAIHGFTTLYADSVKGRFTISRDNAKNSIYLQMNSLRPEDTALYYCNKVPWGDYHPRNVTWGQGTQVTVSS

SEQ ID NO: 357 - protein, 119 aa, Artificial Sequence
  Description of Artificial Sequence: Synthetic polypeptide
EVQLVESGGGLVQPGRSLTLSCAASTNIFSDSPMGWYRQAPGKQRELVAAIHGFSTLYADSVKGRFTISRDNAKNSIYLQMNSLRPEDTALYYCNKVPWGDYHPRNVAWGQGTQVTVSS

SEQ ID NO: 358 - protein, 119 aa, Artificial Sequence
  Description of Artificial Sequence: Synthetic polypeptide
EVQLVESGGGLVQPGRSLTLSCAASTNIFSNSPMGWYRQAPGKQRELVAAIHGGSTLYADSVKGRFTISRDNAKNSIYLQMNSLRPEDTALYYCNKVPWGDYHPRNVHWGQGTQVTVSS

SEQ ID NO: 359 - protein, 119 aa, Artificial Sequence
  Description of Artificial Sequence: Synthetic polypeptide
EVQLVESGGGLVQPGRSLTLSCAASTNIFSNSPMGWYRQAPGKQRELVAAIHGRSTLYADSVKGRFTISRDNAKNSIYLQMNSLRPEDTALYYCNKVPWGDYHPRNVMWGQGTQVTVSS

SEQ ID NO: 360 - protein, 119 aa, Artificial Sequence
  Description of Artificial Sequence: Synthetic polypeptide
EVQLVESGGGLVQPGRSLTLSCAASTNIFSNSPMGWYRQAPGKQRELVAAIHGPSTLYADSVKGRFTISRDNAKNSIYLQMNSLRPEDTALYYCNKVPWGDYHPRNVTWGQGTQVTVSS

SEQ ID NO: 361 - protein, 119 aa, Artificial Sequence
  Description of Artificial Sequence: Synthetic polypeptide
EVQLVESGGGLVQPGRSLTLSCAASTNIFSNSPMGWYRQAPGKQRELVAAIHGDSTLYADSVKGRFTISRDNAKNSIYLQMNSLRPEDTALYYCNKVPWGDYHPRNVRWGQGTQVTVSS

SEQ ID NO: 362 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGDSTLYADSVKGRFTISRDNAKNSIYLQMNSLRPEDTALYYCNKVPWGDYHPRNVTWGQGTQVTVSS

SEQ ID NO: 363 - protein, 119 aa, Artificial Sequence
  Description of Artificial Sequence: Synthetic polypeptide
EVQLVESGGGLVQPGRSLTLSCAASTNIFSKSPMGWYRQAPGKQRELVAAIHGQSTLYADSVKGRFTISRDNAKNSIYLQMNSLRPEDTALYYCNKVPWGDYHPRNVTWGQGTQVTVSS

SEQ ID NO: 364 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGHSTLYADSVKGRFTISRDNAKNSIYLQMNSLRPEDTALYYCNKVPWGDYHPRNVTWGQGTQVTVSS

SEQ ID NO: 365 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGESTLYADSVKGRFTISRDNAKNSIYLQMNSLRPEDTALYYCNKVPWGDYHPRKVYWGQGTQVTVSS

SEQ ID NO: 366 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGNSTLYADSVKGRFTISRDNAKNSIYLQMNSLRPEDTALYYCNKVPWGIYHPRNVYWGQGTQVTVSS

SEQ ID NO: 367 - protein, 119 aa, Artificial Sequence
  Description of Artificial Sequence: Synthetic polypeptide
EVQLVESGGGLVQPGRSLTLSCAASTNIFSESPMGWYRQAPGKQRELVAAIHGNSTLYADSVKGRFTISRDNAKNSIYLQMNSLRPEDTALYYCNKVPWGTYHPRNVYWGQGTQVTVSS

SEQ ID NO: 368 - protein, 119 aa, Artificial Sequence
  Description of Artificial Sequence: Synthetic polypeptide
EVQLVESGGGLVQPGRSLTLSCAASTNIFSVSPMGWYRQAPGKQRELVAAIHGNSTLYADSVKGRFTISRDNAKNSIYLQMNSLRPEDTALYYCNKVPWGKYHPRNVYWGQGTQVTVSS

SEQ ID NO: 369 - protein, 119 aa, Artificial Sequence
  Description of Artificial Sequence: Synthetic polypeptide
EVQLVESGGGLVQPGRSLTLSCAASTNIFSVSPMGWYRQAPGKQRELVAAIHGNSTLYADSVKGRFTISRDNAKNSIYLQMNSLRPEDTALYYCNKVPWGDYHPRNVYWGQGTQVTVSS

SEQ ID NO: 370 - protein, 119 aa, Artificial Sequence
  Description of Artificial Sequence: Synthetic polypeptide
EVQLVESGGGLVQPGRSLTLSCAASTNIFSKSPMGWYRQAPGKQRELVAAIHGNSTLYADSVKGRFTISRDNAKNSIYLQMNSLRPEDTALYYCNKVPWGDYHPREVYWGQGTQVTVSS

SEQ ID NO: 371 - protein, 119 aa, Artificial Sequence
  Description of Artificial Sequence: Synthetic polypeptide
EVQLVESGGGLVQPGRSLTLSCAASTNIFSDSPMGWYRQAPGKQRELVAAIHGTSTLYADSVKGRFTISRDNAKNSIYLQMNSLRPEDTALYYCNKVPWGDYHPRNVYWGQGTQVTVSS

SEQ ID NO: 372 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGTSTLYADSVKGRFTISRDNAKNSIYLQMNSLRPEDTALYYCNKVPWGKYHPRNVYWGQGTQVTVSS

SEQ ID NO: 373 - protein, 119 aa, Artificial Sequence
  Description of Artificial Sequence: Synthetic polypeptide
EVQLVESGGGLVQPGRSLTLSCAASTNIFSHSPMGWYRQAPGKQRELVAAIHGTSTLYADSVKGRFTISRDNAKNSIYLQMNSLRPEDTALYYCNKVPWGRYHPRNVYWGQGTQVTVSS

SEQ ID NO: 374 - protein, 119 aa, Artificial Sequence
  Description of Artificial Sequence: Synthetic polypeptide
EVQLVESGGGLVQPGRSLTLSCAASTNIFSTSPMGWYRQAPGKQRELVAAIHGTSTLYADSVKGRFTISRDNAKNSIYLQMNSLRPEDTALYYCNKVPWGDYHPGNVYWGQGTQVTVSS

SEQ ID NO: 375 - protein, 119 aa, Artificial Sequence
  Description of Artificial Sequence: Synthetic polypeptide
EVQLVESGGGLVQPGRSLTLSCAASTNIFSTSPMGWYRQAPGKQRELVAAIHGTSTLYADSVKGRFTISRDNAKNSIYLQMNSLRPEDTALYYCNKVPWGDYHPRNVQWGQGTQVTVSS

SEQ ID NO: 376 - protein, 119 aa, Artificial Sequence
  Description of Artificial Sequence: Synthetic polypeptide
EVQLVESGGGLVQPGRSLTLSCAASTNIFSLSPMGWYRQAPGKQRELVAAIHGDSTLYADSVKGRFTISRDNAKNSIYLQMNSLRPEDTALYYCNKVPWGDYHPRNVYWGQGTQVTVSS

SEQ ID NO: 377 - protein, 119 aa, Artificial Sequence
  Description of Artificial Sequence: Synthetic polypeptide
EVQLVESGGGLVQPGRSLTLSCAASTNIFSISPGGWYRQAPGKQRELVAAIHGSSTLYADSVKGRFTISRDNAKNSIYLQMNSLRPEDTALYYCNKVPWGDYHPRNVYWGQGTQVTVSS

SEQ ID NO: 378 - protein, 119 aa, Artificial Sequence
  Description of Artificial Sequence: Synthetic polypeptide
EVQLVESGGGLVQPGRSLTLSCAASTNHFSISPMGWYRQAPGKQRELVAAIHGSSTLYADSVKGRFTISRDNAKNSIYLQMNSLRPEDTALYYCNKVPWGDYHPRVVYWGQGTQVTVSS

SEQ ID NO: 379 - protein, 119 aa, Artificial Sequence
  Description of Artificial Sequence: Synthetic polypeptide
EVQLVESGGGLVQPGRSLTLSCAASTNIFSASPMGWYRQAPGKQRELVAAIHGSSTLYADSVKGRFTISRDNAKNSIYLQMNSLRPEDTALYYCNKVPWGDYHPRNVNWGQGTQVTVSS

SEQ ID NO: 380 - protein, 119 aa, Artificial Sequence
  Description of Artificial Sequence: Synthetic polypeptide
EVQLVESGGGLVQPGRSLTLSCAASTNIFSASPMGWYRQAPGKQRELVAAIHGSSTLYADSVKGRFTISRDNAKNSIYLQMNSLRPEDTALYYCNKVPWGRYHPRNVYWGQGTQVTVSS

SEQ ID NO: 381 - protein, 119 aa, Artificial Sequence
  Description of Artificial Sequence: Synthetic polypeptide
EVQLVESGGGLVQPGRSLTLSCAASTNISSISPMGWYRQAPGKQRELVAAIHGTSTLYADSVKGRFTISRDNAKNSIYLQMNSLRPEDTALYYCNKVPWGDYHPGNVYWGQGTQVTVSS

SEQ ID NO: 382 - protein, 119 aa, Artificial Sequence
  Description of Artificial Sequence: Synthetic polypeptide
EVQLVESGGGLVQPGRSLTLSCAASTNIESISPMGWYRQAPGKQRELVAAIHGTSTLYADSVKGRFTISRDNAKNSIYLQMNSLRPEDTALYYCNKVPWGDYHPGNVYWGQGTQVTVSS

SEQ ID NO: 383 - protein, 119 aa, Artificial Sequence
  Description of Artificial Sequence: Synthetic polypeptide
EVQLVESGGGLVQPGRSLTLSCAASTNIFSISPYGWYRQAPGKQRELVAAIHGTSTLYADSVKGRFTISRDNAKNSIYLQMNSLRPEDTALYYCNKVPWGDYHPGNVYWGQGTQVTVSS

SEQ ID NO: 384 - protein, 119 aa, Artificial Sequence
  Description of Artificial Sequence: Synthetic polypeptide
EVQLVESGGGLVQPGRSLTLSCAASTNIASISPMGWYRQAPGKQRELVAAIHGTSTLYADSVKGRFTISRDNAKNSIYLQMNSLRPEDTALYYCNKVPWGDYHPGNVYWGQGTQVTVSS

SEQ ID NO: 385 - protein, 119 aa, Artificial Sequence
  Description of Artificial Sequence: Synthetic polypeptide
EVQLVESGGGLVQPGRSLTLSCAASTNIASISPMGWYRQAPGKQRELVAAIHGKSTLYADSVKGRFTISRDNAKNSIYLQMNSLRPEDTALYYCNKVPWGDYHPGNVYWGQGTQVTVSS

SEQ ID NO: 386 - protein, 119 aa, Artificial Sequence
  Description of Artificial Sequence: Synthetic polypeptide
EVQLVESGGGLVQPGRSLTLSCAASTNIASISPMGWYRQAPGKQRELVAAIHGSSTLYADSVKGRFTISRDNAKNSIYLQMNSLRPEDTALYYCNKVPWGDYHPGNVYWGQGTQVTVSS

SEQ ID NO: 387 - protein, 119 aa, Artificial Sequence
  Description of Artificial Sequence: Synthetic polypeptide
EVQLVESGGGLVQPGRSLTLSCAASTNITSISPMGWYRQAPGKQRELVAAIHGDSTLYADSVKGRFTISRDNAKNSIYLQMNSLRPEDTALYYCNKVPWGDYHPGNVYWGQGTQVTVSS

SEQ ID NO: 388 - protein, 119 aa, Artificial Sequence
  Description of Artificial Sequence: Synthetic polypeptide
EVQLVESGGGLVQPGRSLTLSCAASTNIMSISPMGWYRQAPGKQRELVAAIHGNSTLYADSVKGRFTISRDNAKNSIYLQMNSLRPEDTALYYCNKVPWGDYHPGNVYWGQGTQVTVSS

SEQ ID NO: 389 - protein, 119 aa, Artificial Sequence
  Description of Artificial Sequence: Synthetic polypeptide
EVQLVESGGGLVQPGRSLTLSCAASTNITSISPMGWYRQAPGKQRELVAAIHGNSTLYADSVKGRFTISRDNAKNSIYLQMNSLRPEDTALYYCNKVPWGDYHPGNVYWGQGTQVTVSS

SEQ ID NO: 390 - protein, 119 aa, Artificial Sequence
  Description of Artificial Sequence: Synthetic polypeptide
EVQLVESGGGLVQPGRSLTLSCAASTNIVSISPMGWYRQAPGKQRELVAAIHGHSTLYADSVKGRFTISRDNAKNSIYLQMNSLRPEDTALYYCNKVPWGDYHPGNVYWGQGTQVTVSS

SEQ ID NO: 391 - protein, 119 aa, Artificial Sequence
  Description of Artificial Sequence: Synthetic polypeptide
EVQLVESGGGLVQPGRSLTLSCAASTNIVSISPMGWYRQAPGKQRELVAAIHGKSTLYADSVKGRFTISRDNAKNSIYLQMNSLRPEDTALYYCNKVPWGDYHPGNVYWGQGTQVTVSS

SEQ ID NO: 392 - protein, 119 aa, Artificial Sequence
  Description of Artificial Sequence: Synthetic polypeptide
EVQLVESGGGLVQPGRSLTLSCAASTNVVSISPMGWYRQAPGKQRELVAAIHGKSTLYADSVKGRFTISRDNAKNSIYLQMNSLRPEDTALYYCNKVPWGDYHPNNVYWGQGTQVTVSS

SEQ ID NO: 393 - protein, 119 aa, Artificial Sequence
  Description of Artificial Sequence: Synthetic polypeptide
EVQLVESGGGLVQPGRSLTLSCAASTNIISISPMGWYRQAPGKQRELVAAIHGASTLYADSVKGRFTISRDNAKNSIYLQMNSLRPEDTALYYCNKVPWGDYHPGNVYWGQGTQVTVSS

SEQ ID NO: 394 - protein, 119 aa, Artificial Sequence
  Description of Artificial Sequence: Synthetic polypeptide
EVQLVESGGGLVQPGRSLTLSCAASTNIFSITPMGWYRQAPGKQRELVAAIHGASTLYADSVKGRFTISRDNAKNSIYLQMNSLRPEDTALYYCNKVPWGDYHPGNVYWGQGTQVTVSS

SEQ ID NO: 395 - protein, 119 aa, Artificial Sequence
  Description of Artificial Sequence: Synthetic polypeptide
EVQLVESGGGLVQPGRSLTLSCAASTNITSISPMGWYRQAPGKQRELVAAIHGFETLYADSVKGRFTISRDNAKNSIYLQMNSLRPEDTALYYCNKVPWGDYHPGNVYWGQGTQVTVSS

SEQ ID NO: 396 - protein, 119 aa, Artificial Sequence
  Description of Artificial Sequence: Synthetic polypeptide
EVQLVESGGGLVQPGRSLTLSCAASTNIQSISPMGWYRQAPGKQRELVAAIHGFETLYADSVKGRFTISRDNAKNSIYLQMNSLRPEDTALYYCNKVPWGDYHPGNVYWGQGTQVTVSS

SEQ ID NO: 397 - protein, 119 aa, Artificial Sequence
  Description of Artificial Sequence: Synthetic polypeptide
EVQLVESGGGLVQPGRSLTLSCAASTSDFSISPMGWYRQAPGKQRELVAAIHGFETLYADSVKGRFTISRDNAKNSIYLQMNSLRPEDTALYYCNKVPWGDYHPGNVYWGQGTQVTVSS

SEQ ID NO: 398 - protein, 119 aa, Artificial Sequence
  Description of Artificial Sequence: Synthetic polypeptide
EVQLVESGGGLVQPGRSLTLSCAASTNIDSISPMGWYRQAPGKQRELVAAIHGFQTLYADSVKGRFTISRDNAKNSIYLQMNSLRPEDTALYYCNKVPWGDYHPGNVYWGQGTQVTVSS

SEQ ID NO: 399 - protein, 119 aa, Artificial Sequence
  Description of Artificial Sequence: Synthetic polypeptide
EVQLVESGGGLVQPGRSLTLSCAASTNIMSISPMGWYRQAPGKQRELVAAIHGFSTVYADSVKGRFTISRDNAKNSIYLQMNSLRPEDTALYYCNKVPWGDYHPGNVYWGQGTQVTVSS

SEQ ID NO: 400 - protein, 119 aa, Artificial Sequence
  Description of Artificial Sequence: Synthetic polypeptide
EVQLVESGGGLVQPGRSLTLSCAASTNIESISPMGWYRQAPGKQRELVAAIHGFSTLYADSVKGRFTISRDNAKNSIYLQMNSLRPEDTALYYCNKVPWGDYHPGNVYWGQGTQVTVSS

SEQ ID NO: 401 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGFKTLYADSVKGRFTISRDNAKNSIYLQMNSLRPEDTARYYCNKVPWGDYHPGNVYWGQGTQVTVSS

SEQ ID NO: 402 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGFSTLYADSVKGRFTISRDNAKNSIYLQMNSLRPEDTALYYCNKVPWGDYHPGNVYWGQGTQVTVSS

SEQ ID NO: 403 - protein, 119 aa, Artificial Sequence
  Description of Artificial Sequence: Synthetic polypeptide
EVQLVESGGGLVQPGRSLTLSCAASTNIFSNSPMGWYRQAPGKQRELVAAIHGFSTLYADSVKGRFTISRDNAKNSIYLQMNSLRPEDTALYYCNKVPWGDYHPGNVYWGQGTQVTVSS

SEQ ID NO: 404 - protein, 119 aa, Artificial Sequence
  Description of Artificial Sequence: Synthetic polypeptide
EVQLVESGGGLVQPGRSLTLSCAASTNIFSTSPMGWYRQAPGKQRELVAAIHGFSTIYADSVKGRFTISRDNAKNSIYLQMNSLRPEDTALYYCNKVPWGDYHPGNVYWGQGTQVTVSS

SEQ ID NO: 405 - protein, 119 aa, Artificial Sequence
  Description of Artificial Sequence: Synthetic polypeptide
EVQLVESGGGLVQPGRSLTLSCAASTNIFSTSPMGWYRQAPGKQRELVAAIHGFSTIYADSVKGRFTISRDNAKNSIYLQMNSLRPEDTALYYCNKVPWGDYHPLNVYWGQGTQVTVSS

SEQ ID NO: 406 - protein, 119 aa, Artificial Sequence
  Description of Artificial Sequence: Synthetic polypeptide
EVQLVESGGGLVQPGRSLTLSCVASTNIFSTSPMGWYRQAPGKQRELVAAIHGFSTLYADSVKGRFTISRDNAKNSIYLQMNSLRPEDTALYYCNKVPWGDYHPGNVYWGQGTQVTVSS

SEQ ID NO: 407 - protein, 119 aa, Artificial Sequence
  Description of Artificial Sequence: Synthetic polypeptide
EVQLVESGGGLVQPGRSLTLSCAASTNIFSDSPMGWYRQAPGKQRELVAAIHGFSTFYADSVKGRFTISRDNAKNSIYLQMNSLRPEDTALYYCNKVPWGDYHPGNVYWGQGTQVTVSS

SEQ ID NO: 408 - protein, 119 aa, Artificial Sequence
  Description of Artificial Sequence: Synthetic polypeptide
EVQLVESGGGLVQPGRSLTLSCAASTNIFSQSPMGWYRQAPGKQRELVAAIHGDSTLYADSVKGRFTISRDNAKNSIYLQMNSLRPEDTALYYCNKVPWGDYHPGNVCWGQGTQVTVSS

SEQ ID NO: 409 - protein, 119 aa, Artificial Sequence
  Description of Artificial Sequence: Synthetic polypeptide
EVQLVESGGGLVQPGRSLTLSCAASTNIFSQSPMGWYRQAPGKQRELVAAIHGKSTLYADSVKGRFTISRDNAKNSIYLQMNSLRPEDTALYYCNKVPWGDYHPSNVYWGKGTQVTVSS

SEQ ID NO: 410 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGESTLYADSVKGRFTISRDNAKNSIYLQMNSLRPEDTALYYCNKVPWGRYHPGNVYWGQGTQVTVSS

SEQ ID NO: 411 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGISTLYADSVKGRFTISRDNAKNSIYLQMNSLRPEDTALYYCNKVPWGDYHPGNVYWGQGTQVTVSS

SEQ ID NO: 412 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGSSTLYADSVKGRFTISRDNAKNSIYLQMNSLRPEDTALYYCNKVPWGDYHPGNVYWGQGTQVTVSS

SEQ ID NO: 413 - protein, 119 aa, Artificial Sequence
  Description of Artificial Sequence: Synthetic polypeptide
EVQLVESGGGLVQPGRSLTLSCAASTNIFSGSPMGWYRQAPGKQRELVAAIHGNSTLYADSVKGRFTISRDNAKNSIYLQMNSLRPEDTALYYCNKVPWGDYHPGNVYWGQGTQVTVSS

SEQ ID NO: 414 - protein, 119 aa, Artificial Sequence
  Description of Artificial Sequence: Synthetic polypeptide
EVQLVESGGGLVQPGRSLTLSCAASSNIFSISPMGWYRQAPGKQRELVAAIHGSSTLYADSVKGRFTISRDNAKNSIYLQMNSLRPEDTALYYCNKVPWGDYHPGNVYWGQGTQVTVSS

SEQ ID NO: 415 - protein, 119 aa, Artificial Sequence
  Description of Artificial Sequence: Synthetic polypeptide
EVQLVESGGGLVQPGRSLTLSCAASTNIFSIYPMGWYRQAPGKQRELVAAIHGSSTLYADSVKGRFTISRDNAKNSIYLQMNSLRPEDTALYYCNKVPWGDYHPKNVYWGQGTQVTVSS

SEQ ID NO: 416 - protein, 119 aa, Artificial Sequence
  Description of Artificial Sequence: Synthetic polypeptide
EVQLVESGGGLVQPGRSLTLSCAASTNIFSKSPMGWYRQAPGKQRELVAAIHGSSTLYADSVKGRFTISRDNAKNSIYLQMNSLRPEDTALYYCNKVPWGDYHPGNVYWGQGTQVTVSS

SEQ ID NO: 417 - protein, 119 aa, Artificial Sequence
  Description of Artificial Sequence: Synthetic polypeptide
EVQLVESGGGLVQPGRSLTLSCAASTNIFSKSPMGWYRQAPGKQRELVAAIHGSSTLYADSVKGRFTISRDNAKNSIYLQMNSLRPEDTALYYCNKVPWGDYHPRNVYWGQGTQVTVSS

SEQ ID NO: 418 - protein, 119 aa, Artificial Sequence
  Description of Artificial Sequence: Synthetic polypeptide
EVQLVESGGGLVQPGRSLTLSCAASTNEFSISPMGWYRQAPGKQRELVAAIHGLSTLYADSVKGRFTISRDNAKNSIYLQMNSLRPEDTALYYCNKVPWGAYHPRNVYWGQGTQVTVSS

SEQ ID NO: 419 - protein, 119 aa, Artificial Sequence
  Description of Artificial Sequence: Synthetic polypeptide
EVQLVESGGGLVQPGRSLTLSCAASTNEFSISPMGWYRQAPGKQRELVAAIHGESTLYADSVKGRFTISRDNAKNSIYLQMNSLRPEDTALYYCNKVPWGDYHPGNVYWGQGTQVTVSS

SEQ ID NO: 420 - protein, 119 aa, Artificial Sequence
  Description of Artificial Sequence: Synthetic polypeptide
EVQLVESGGGLVQPGRSLTLSCAASTNIPSISPMGWYRQAPGKQRELVAAIHGESTLYADSVKGRFTISRDNAKNSIYLQMNSLRPEDTALYYCNKVPWGDYHPRNVAWGQGTQVTVSS

SEQ ID NO: 421 - protein, 119 aa, Artificial Sequence
  Description of Artificial Sequence: Synthetic polypeptide
EVQLVESGGGLVQPGRSLTLSCAASTNIPSISPMGWYRQAPGKQRELVAAIHGASTLYADSVKGRFTISRDNAKNSIYLQMNSLRPEDTALYYCNKVPWGDYHPRNVAWGQGTQVTVSS

SEQ ID NO: 422 - protein, 119 aa, Artificial Sequence
  Description of Artificial Sequence: Synthetic polypeptide
EVQLVESGGGLVQPGRSLTLSCAASTNIPSISPMGWYRQAPGKQRELVAAIHGESTLYADSVKGRFTISRDNAKNSIYLQMNSLRPEDTALYYCNKVPWGDYHPRNVYWGQGTQVTVSS

SEQ ID NO: 423 - protein, 119 aa, Artificial Sequence
  Description of Artificial Sequence: Synthetic polypeptide
EVQLVESGGGLVQPGRSLTLSCAASTNIPSISPMGWYRQAPGKQRELVAAIHGDSTLYADSVKGRFTISRDNAKNSIYLQMNSLRPEDTALYYCNKVPWGDYHPRNVYWGQGTQVTVSS

SEQ ID NO: 424 - protein, 119 aa, Artificial Sequence
  Description of Artificial Sequence: Synthetic polypeptide
EVQLVESGGGLVQPGRSLTLSCAASTNITSISPMGWYRQAPGKQRELVAAIHGVSTLYADSVKGRFTISRDNAKNSIYLQMNSLRPEDTALYYCNKVPWGDYHPRNVQWGQGTQVTVSS

SEQ ID NO: 425 - protein, 119 aa, Artificial Sequence
  Description of Artificial Sequence: Synthetic polypeptide
EVQLVESGGGLVQPGRSLTLSCAASTNIPSISPMGWYRQAPGKQRELVAAIHGQSTLYADSVKGRFTISRDNAKNSIYLQMNSLRPEDTALYYCNKVPWGDYHPRNVQWGQGTQVTVSS

SEQ ID NO: 426 - protein, 119 aa, Artificial Sequence
  Description of Artificial Sequence: Synthetic polypeptide
EVQLVESGGGLVQPGRSLTLSCAASTNIVSISPMGWYRQAPGKQRELVAAIHGDSTLYADSVKGRFTISRDNAKNSIYLQMNSLRPEDTALYYCNKVPWGDYHPRNVSWGQGTQVTVSS

SEQ ID NO: 427 - protein, 119 aa, Artificial Sequence
  Description of Artificial Sequence: Synthetic polypeptide
EVQLVESGGGLVQPGRSLTLSCAASSNIFSISPMGWYRQAPGKQRELVAAIHGESTLYADSVKGRFTISRDNAKNSIYLQMNSLRPEDTALYYCNKVPWGDYHPRNVTWGQGTQVTVSS

SEQ ID NO: 428 - protein, 119 aa, Artificial Sequence
  Description of Artificial Sequence: Synthetic polypeptide
EVQLVESGGGLVQPGRSLTLSCAASTNIDSISPMGWYRQAPGKQRELVAAIHGESTLYADSVKGRFTISRDNAKNSIYLQMNSLRPEDTALYYCNKVPWGDYHPRNVTWGQGTQVTVSS

SEQ ID NO: 429 - protein, 119 aa, Artificial Sequence
  Description of Artificial Sequence: Synthetic polypeptide
EVQLVESGGGLVQPGRSLTLSCAASTNIDSISPMGWYRQAPGKQRELVAAIHGSSTLYADSVKGRFTISRDNAKNSIYLQMNSLRPEDTALYYCNKVPWGDYHPRNVTWGQGTQVTVSS

SEQ ID NO: 430 - protein, 119 aa, Artificial Sequence
  Description of Artificial Sequence: Synthetic polypeptide
EVQLVESGGGLVQPGRSLTLSCAASTNIRSISPMGWYRQAPGKQRELVAAIHGSSTLYADSVKGRFTISRDNAKNSIYLQMNSLRPEDTALYYCNKVPWGDYHPRNVVWGQGTQVTVSS

SEQ ID NO: 431 - protein, 119 aa, Artificial Sequence
  Description of Artificial Sequence: Synthetic polypeptide
EVQLVESGGGLVQPGRSLTLSCAASTNITSISPMGWYRQAPGKQRELVAAISGFSTLYADSVKGRFTISRDNAKNSIYLQMNSLRPEDTALYYCNEVPWGDYHPRNVYWGQGTQVTVSS

SEQ ID NO: 432 - protein, 119 aa, Artificial Sequence
  Description of Artificial Sequence: Synthetic polypeptide
EVQLVESGGGLVQPGRSLTLSCAASTNITSISPMGWYRQAPGKQRELVAAIHGESTLYADSVKGRFTISRDNAKNSIYLQMNSLRPEDTALYYCNKVPWGDYHPRNVYWGQGTQVTVSS

SEQ ID NO: 433 - protein, 119 aa, Artificial Sequence
  Description of Artificial Sequence: Synthetic polypeptide
EVQLVESGGGLVQPGRSLTLSCAASTNITSVSPMGWYRQAPGKQRELVAAIHGPSTLYADSVKGRFTISRDNAKNSIYLQMNSLRPEDTALYYCNKVPWGDYHPTNVYWGQGTQVTVSS

SEQ ID NO: 434 - protein, 119 aa, Artificial Sequence
  Description of Artificial Sequence: Synthetic polypeptide
EVQLVESGGGLVQPGRSLTLSCAASTNIGSISPMGWYRQAPGKQRELVAAIHGQSTLYADSVKGRFTISRDNAKNSIYLQMNSLRPEDTALYYCNKVPWGDYHPQNVYWGQGTQVTVSS

SEQ ID NO: 435 - protein, 119 aa, Artificial Sequence
  Description of Artificial Sequence: Synthetic polypeptide
EVQLVESGGGLVQPGRSLTLSCAASTNIESISPMGWYRQAPGKQRELVAAIHGKSTLYADSVKGRFTISRDNAKNSIYLQMNSLRPEDTALYYCNKVPWGDYHPRRVYWGQGTQVTVSS

SEQ ID NO: 436 - protein, 119 aa, Artificial Sequence
  Description of Artificial Sequence: Synthetic polypeptide
EVQLVESGGGLVQPGRSLTLSCAASTNIVSISPMGWYRQAPGKQRELVAAIHGDSTLYADSVKGRFTISRDNAKNSIYLQMNSLRPEDTALYYCNKVPWGDYHPRRVYWGQGTQVTVSS

SEQ ID NO: 437 - protein, 119 aa, Artificial Sequence
  Description of Artificial Sequence: Synthetic polypeptide
EVQLVESGGGLVQPGRSLTLSCAASTNIDSISPMGWYRQAPGKQRELVAAIHGNSTLYADSVKGRFTISRDNAKNSIYLQMNSLRPEDTALYYCNKVPWGDYHPRMVYWGQGTQVTVSS

SEQ ID NO: 438 - protein, 119 aa, Artificial Sequence
  Description of Artificial Sequence: Synthetic polypeptide
EVQLVESGGGLVQPGRSLTLSCAASTNIFMISPMGWYRQAPGKQRELVAAIHGDSTLYADSVKGRFTISRDNAKNSIYLQMNSLRPEDTALYYCNKVPWGRYHPRNVYWGQGTQVTVSS

SEQ ID NO: 439 - protein, 119 aa, Artificial Sequence
  Description of Artificial Sequence: Synthetic polypeptide
EVQLVESGGGLVQPGRSLTLSCAASTNIFRISPMGWYRQAPGKQRELVAAIHGDSTLYADSVKGRFTISRDNAKNSIYLQMNSLRPEDTALYYCNKVPWGRYHPRNVYWGQGTQVTVSS

SEQ ID NO: 440 - protein, 119 aa, Artificial Sequence
  Description of Artificial Sequence: Synthetic polypeptide
EVQLVESGGGLVQPGRSLTLSCAASTNIFSISPMGWYRQAPGKQRELVAAIHGDSTLYADSVKGRFTISRDNAKNSIYLQMNSLRPEDTALYYCNKVPWGEYHPRNVYWGQGTQVTVSS

SEQ ID NO: 441 - protein, 119 aa, Artificial Sequence
  Description of Artificial Sequence: Synthetic polypeptide
EVQLVESGGGLVQPGRSLTLSCAASTNIFSISPMGWYRQAPGKQRELVAAIHGDSTLYADSVKGRFTISRDNAKNSIYLQMNSLRPEDTALYYCNKVPWGKYHPRNVYWGQGTQVTVSS

SEQ ID NO: 442 - protein, 119 aa, Artificial Sequence
  Description of Artificial Sequence: Synthetic polypeptide
EVQLVESGGGLVQPGRSLTLSCAASTNIESISPMGWYRQAPGKQRELVAAIHGSSTLYADSVKGRFTISRDNAKNSIYLQMNSLRPEDTALYYCNKVPWGRYHPRNVYWGQGTQVTVSS

SEQ ID NO: 443 - protein, 119 aa, Artificial Sequence
  Description of Artificial Sequence: Synthetic polypeptide
EVQLVESGGGLVQPGRSLTLSCAASTNIESISPMGWYRQAPGKQRELVAAIHGNSTLYADSVKGRFTISRDNAKNSIYLQMNSLRPEDTALYYCNKVPWGRYHPRNVYWGQGTQVTVSS

SEQ ID NO: 444 - protein, 119 aa, Artificial Sequence
  Description of Artificial Sequence: Synthetic polypeptide
EVQLVESGGGLVQPGRSLTLSCAASTNISSISPMGWYRQAPGKQRELVAAIHGFSTLYADSVKGRFTISRDNAKNSIYLQMNSLRPEDTALYYCNKVPWGYYHPRNVYWGQGTQVTVSS

SEQ ID NO: 445 - protein, 119 aa, Artificial Sequence
  Description of Artificial Sequence: Synthetic polypeptide
EVQLVESGGGLVQPGRSLTLSCAASTNISSISPMGWYRQAPGKQRELVAAIHGHSTLYADSVKGRFTISRDNAKNSIYLQMNSLRPEDTALYYCNKVPWGRYHPRNVYWGQGTQVTVSS

SEQ ID NO: 446 - protein, 119 aa, Artificial Sequence
  Description of Artificial Sequence: Synthetic polypeptide
EVQLVESGGGLVQPGRSLTLSCAASTNISSISPMGWYRQAPGKQRELVAAIHGFSTVYADSVKGRFTISRDNAKNSIYLQMNSLRPEDTALYYCNKVPWGRYHPRNVYWGQGTQVTVSS

SEQ ID NO: 447 - protein, 119 aa, Artificial Sequence
  Description of Artificial Sequence: Synthetic polypeptide
EVQLVESGGGLVQPGRSLTLSCAASTNIFSIRPMGWYRQAPGKQRELVAAIHGFSTVYADSVKGRFTISRDNAKNSIYLQMNSLRPEDTALYYCNKVPWGDYHPRNVYWGQGTQVTVSS

SEQ ID NO: 448 - protein, 119 aa, Artificial Sequence
  Description of Artificial Sequence: Synthetic polypeptide
EVQLVESGGGLVQPGRSLTLSCAASTNIFSIYPMGWYRQAPGKQRELVAAIHGFSTYYADSVKGRFTISRDNAKNSIYLQMNSLRPEDTALYYCNKVPWGSYHPRNVYWGQGTQVTVSS

SEQ ID NO: 449 - protein, 119 aa, Artificial Sequence
  Description of Artificial Sequence: Synthetic polypeptide
EVQLVESGGGLVQPGRSLTLSCAASTNIFNISPMGWYRQAPGKQRELVAAIHGFSTYYADSVKGRFTISRDNAKNSIYLQMNSLRPEDTALYYCNKVPWGRYHPRNVYWGQGTQVTVSS

SEQ ID NO: 450 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGFSTWYADSVKGRFTISRDNAKNSIYLQMNSLRPEDTALYYCNKVPWGRYHPRNVYWGQGTQVTVSS

SEQ ID NO: 451 - protein, 119 aa, Artificial Sequence
  Description of Artificial Sequence: Synthetic polypeptide
EVQLVESGGGLVQPGRSLTLSCAASTNISSISPMGWYRQAPGKQRELVAAIHGFDTLYADSVKGRFTISRDNAKNSIYLQMNSLRPEDTALYYCNKVPWGDYHPRNVYWGQGTQVTVSS

SEQ ID NO: 452 - protein, 119 aa, Artificial Sequence
  Description of Artificial Sequence: Synthetic polypeptide
EVQLVESGGGLVQPGRSLTLSCAASTNIFSINPMGWYRQAPGKQRELVAAIHGFDTLYADSVKGRFTISRDNAKNSIYLQMNSLRPEDTALYYCNKVPWGDYHPRNVSWGQGTQVTVSS

SEQ ID NO: 453 - protein, 119 aa, Artificial Sequence
  Description of Artificial Sequence: Synthetic polypeptide
EVQLVESGGGLVQPGRSLTLSCAASTNIFSITPMGWYRQAPGKQRELVAAIHGRSTLYADSVKGRFTISRDNAKNSIYLQMNSLRPEDTALYYCNKVPWGSYHPRNVYWGQGTQVTVSS

SEQ ID NO: 454 - protein, 119 aa, Artificial Sequence
  Description of Artificial Sequence: Synthetic polypeptide
EVQLVESGGGLVQPGRSLTLSCAASTNIFSITPMGWYRQAPGKQRELVAAIHGTSTLYADSVKGRFTISRDNAKNSIYLQMNSLRPEDTALYYCNKVPWGRYHPRNVYWGQGTQVTVSS

SEQ ID NO: 455 - protein, 119 aa, Artificial Sequence
  Description of Artificial Sequence: Synthetic polypeptide
EVQLVESGGGLVQPGRSLTLSCAASTNIFSITPMGWYRQAPGKQRELVAAIHGESTLYADSVKGRFTISRDNAKNSIYLQMNSLRPEDTALYYCNKVPWGRYHPRNVYWGQGTQVTVSS

SEQ ID NO: 456 - protein, 119 aa, Artificial Sequence
  Description of Artificial Sequence: Synthetic polypeptide
EVQLVESGGGLVQPGRSLTLSCAASTNIFSITPMGWYRQAPGKQRELVAAIHGESTLYADSVKGRFTISRDNAKNSIYLQMNSLRPEDTALYYCNKVPWGDYHPRDVYWGQGTQVTVSS

SEQ ID NO: 457 - protein, 119 aa, Artificial Sequence
  Description of Artificial Sequence: Synthetic polypeptide
EVQLVESGGGLVQPGRSLTLSCAASTNIFSTSPYGWYRQAPGKQRELVAAIHGFSTIYADSVKGRFTISRDNAKNSIYLQMNSLRPEDTALYYCNKVPWGDYHPGNVYWGQGTQVTVSS

SEQ ID NO: 458 - protein, 119 aa, Artificial Sequence
  Description of Artificial Sequence: Synthetic polypeptide
EVQLVESGGGLVQPGRSLTLSCAASTNIFSTSPGGWYRQAPGKQRELVAAIHGFSTIYADSVKGRFTISRDNAKNSIYLQMNSLRPEDTALYYCNKVPWGDYHPGNVYWGQGTQVTVSS

SEQ ID NO: 459 - protein, 119 aa, Artificial Sequence
  Description of Artificial Sequence: Synthetic polypeptide
EVQLVESGGGLVQPGRSLTLSCAASTNIFSITPYGWYRQAPGKQRELVAAIHGASTLYADSVKGRFTISRDNAKNSIYLQMNSLRPEDTALYYCNKVPWGDYHPGNVYWGQGTQVTVSS

SEQ ID NO: 460 - protein, 119 aa, Artificial Sequence
  Description of Artificial Sequence: Synthetic polypeptide
EVQLVESGGGLVQPGRSLTLSCAASTNIFSITPGGWYRQAPGKQRELVAAIHGASTLYADSVKGRFTISRDNAKNSIYLQMNSLRPEDTALYYCNKVPWGDYHPGNVYWGQGTQVTVSS

SEQ ID NO: 461 - protein, 25 aa, Artificial Sequence
  Description of Artificial Sequence: Synthetic peptide
EVQLVESGGGLVQPGRSLTLSCAAS

SEQ ID NO: 462 - protein, 25 aa, Artificial Sequence
  Description of Artificial Sequence: Synthetic peptide
EVQLVESGGGLVQPGRSLTLSCVAS

SEQ ID NO: 463 - protein, 14 aa, Artificial Sequence
  Description of Artificial Sequence: Synthetic peptide
WYRQAPGKQRELVA

SEQ ID NO: 464 - protein, 33 aa, Artificial Sequence
  Description of Artificial Sequence: Synthetic polypeptide
GRFTISRDNAKNSIYLQMNSLRPEDTALYYCNK

SEQ ID NO: 465 - protein, 33 aa, Artificial Sequence
  Description of Artificial Sequence: Synthetic polypeptide
GRFTISRDNAKNSIYLQMNSLRPEDTALYYCNE

SEQ ID NO: 466 - protein, 11 aa, Artificial Sequence
  Description of Artificial Sequence: Synthetic peptide
WGQGTQVTVSS

SEQ ID NO: 467 - protein, 11 aa, Artificial Sequence
  Description of Artificial Sequence: Synthetic peptide
WGKGTQVTVSS

SEQ ID NO: 468 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 469 - protein, 185 aa, Mus sp.
MAQQCFHSEYFDSLLHACKPCHLRCSNPPATCQPYCDPSVTSSVKGTYTVLWIFLGLTLVLSLALFTISFLLRKMNPEALKDEPQSPGQLDGSAQLDKADTELTRIRAGDDRIFPRSLEYTVEECTCEDCVKSKPKGDSDHFFPLPAMEEGATILVTTKTGDYGKSSVPTALQSVMGMEKPTHTR

SEQ ID NO: 470 - protein, 183 aa, Macaca fascicularis
MLQMARQCSQNEYFDSLLHDCKPCQLRCSSTPPLTCQRYCNASMTNSVKGMNAILWTCLGLSLIISLAVFVLTFLLRKMSSEPLKDEFKNTGSGLLGMANIDLEKGRTGDEIVLPRGLEYTVEECTCEDCIKNKPKVDSDHCFPLPAMEEGATILVTTKTNDYCNSLSAALSVTEIEKSISAR

SEQ ID NO: 471 - protein, 6 aa, Artificial Sequence
  Description of Artificial Sequence: Synthetic 6xHis tag
HHHHHH

SEQ ID NO: 472 - protein, 20 aa, Artificial Sequence
  Description of Artificial Sequence: Synthetic peptide
  MISC_FEATURE (1)..(20): This sequence may encompass 1-10 'Gly Ser' repeating units
GSGSGSGSGSGSGSGSGSGS

SEQ ID NO: 473 - protein, 30 aa, Artificial Sequence
  Description of Artificial Sequence: Synthetic polypeptide
  MISC_FEATURE (1)..(30): This sequence may encompass 1-10 'Gly Gly Ser' repeating units
GGSGGSGGSGGSGGSGGSGGSGGSGGSGGS

SEQ ID NO: 474 - protein, 40 aa, Artificial Sequence
  Description of Artificial Sequence: Synthetic polypeptide
  MISC_FEATURE (1)..(40): This sequence may encompass 1-10 'Gly Gly Gly Ser' repeating units
GGGSGGGSGGGSGGGSGGGSGGGSGGGSGGGSGGGSGGGS

SEQ ID NO: 475 - protein, 40 aa, Artificial Sequence
  Description of Artificial Sequence: Synthetic polypeptide
  MISC_FEATURE (1)..(40): This sequence may encompass 1-10 'Gly Gly Ser Gly' repeating units
GGSGGGSGGGSGGGSGGGSGGGSGGGSGGGSGGGSGGGSG

SEQ ID NO: 476 - protein, 50 aa, Artificial Sequence
  Description of Artificial Sequence: Synthetic polypeptide
  MISC_FEATURE (1)..(50): This sequence may encompass 1-10 'Gly Gly Ser Gly Gly' repeating units
GGSGGGGSGGGGSGGGGSGGGGSGGGGSGGGGSGGGGSGGGGSGGGGSGG

SEQ ID NO: 477 - protein, 50 aa, Artificial Sequence
  Description of Artificial Sequence: Synthetic polypeptide
  MISC_FEATURE (1)..(50): This sequence may encompass 1-10 'Gly Gly Gly Gly Ser' repeating units
GGGGSGGGGSGGGGSGGGGSGGGGSGGGGSGGGGSGGGGSGGGGSGGGGS

SEQ ID NO: 478 - protein, 50 aa, Artificial Sequence
  Description of Artificial Sequence: Synthetic polypeptide
  MISC_FEATURE (1)..(50): This sequence may encompass 1-10 'Gly Gly Gly Gly Gly' repeating units
GGGGGGGGGGGGGGGGGGGGGGGGGGGGGGGGGGGGGGGGGGGGGGGGGG

SEQ ID NO: 479 - protein, 30 aa, Artificial Sequence
  Description of Artificial Sequence: Synthetic polypeptide
  MISC_FEATURE (1)..(30): This sequence may encompass 1-10 'Gly Gly Gly' repeating units
GGGGGGGGGGGGGGGGGGGGGGGGGGGGGG

SEQ ID NO: 480 - protein, 20 aa, Artificial Sequence
  Description of Artificial Sequence: Synthetic peptide
GGGGSGGGGSGGGGSGGGGS

SEQ ID NO: 481 - protein, 15 aa, Artificial Sequence
  Description of Artificial Sequence: Synthetic peptide
GGGGSGGGGSGGGGS

SEQ ID NO: 482 - protein, 5 aa, Artificial Sequence
  Description of Artificial Sequence: Synthetic peptide
LPETG

SEQ ID NO: 483 - protein, 507 aa, Artificial Sequence
  Description of Artificial Sequence: Synthetic polypeptide
EVQLVESGGGLVQPGRSLTLSCAASTNIFSISPMGWYRQAPGKQRELVAAIHGFSTLYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 484 - protein, 507 aa, Artificial Sequence
  Description of Artificial Sequence: Synthetic polypeptide
EVQLVESGGGLVQPGRSLTLSCAASTDIFSISPMGWYRQAPGKQRELVAAIHGGSTLYADSVKGRFTISRDNAKNSIYLQMNSLRPEDTALYYCNKVPWGDYHPRNVAWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 485 - protein, 507 aa, Artificial Sequence
  Description of Artificial Sequence: Synthetic polypeptide
EVQLVESGGGLVQPGRSLTLSCAASTNDFSISPMGWYRQAPGKQRELVAAIHGGSTLYADSVKGRFTISRDNAKNSIYLQMNSLRPEDTALYYCNKVPWGDYHPRNVAWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 486 - protein, 507 aa, Artificial Sequence
  Description of Artificial Sequence: Synthetic polypeptide
EVQLVESGGGLVQPGRSLTLSCAASTNIFSKSPMGWYRQAPGKQRELVAAIHGKSTLYADSVKGRFTISRDNAKNSIYLQMNSLRPEDTALYYCNKVPWGDYHPRNVVWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 487 - protein, 507 aa, Artificial Sequence
  Description of Artificial Sequence: Synthetic polypeptide
EVQLVESGGGLVQPGRSLTLSCAASTNDFSISPMGWYRQAPGKQRELVAAIHGKSTLYADSVKGRFTISRDNAKNSIYLQMNSLRPEDTALYYCNKVPWGDYHPRNVKWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 488 - protein, 507 aa, Artificial Sequence
  Description of Artificial Sequence: Synthetic polypeptide
EVQLVESGGGLVQPGRSLTLSCAASTNQFSISPMGWYRQAPGKQRELVAAIHGKSTLYADSVKGRFTISRDNAKNSIYLQMNSLRPEDTALYYCNKVPWGDYHPRNVVWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 489 - protein, 507 aa, Artificial Sequence
  Description of Artificial Sequence: Synthetic polypeptide
EVQLVESGGGLVQPGRSLTLSCAASTNIFSSSPMGWYRQAPGKQRELVAAINGFSTLYADSVKGRFTISRDNAKNSIYLQMNSLRPEDTALYYCNKVPWGDYHPRNVHWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 490 - protein, 507 aa, Artificial Sequence
  Description of Artificial Sequence: Synthetic polypeptide
EVQLVESGGGLVQPGRSLTLSCAASTNIFSSSPMGWYRQAPGKQRELVAAIHGFSTLYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 491 - protein, 507 aa, Artificial Sequence
  Description of Artificial Sequence: Synthetic polypeptide
EVQLVESGGGLVQPGRSLTLSCAASTNIFSTSPMGWYRQAPGKQRELVAAIHGFQTLYADSVKGRFTISRDNAKNSIYLQMNSLRPEDTALYYCNKVPWGDYHPRNVVWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 492 - protein, 507 aa, Artificial Sequence
  Description of Artificial Sequence: Synthetic polypeptide
EVQLVESGGGLVQPGRSLTLSCAASTNIFSRSPMGWYRQAPGKQRELVAAIHGFETLYADSVKGRFTISRDNAKNSIYLQMNSLRPEDTALYYCNKVPWGDYHPRNVLWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 493 - protein, 507 aa, Artificial Sequence
  Description of Artificial Sequence: Synthetic polypeptide
EVQLVESGGGLVQPGRSLTLSCAASTNIFSESPMGWYRQAPGKQRELVAAIHGFTTLYADSVKGRFTISRDNAKNSIYLQMNSLRPEDTALYYCNKVPWGDYHPRNVTWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 494 - protein, 507 aa, Artificial Sequence
  Description of Artificial Sequence: Synthetic polypeptide
EVQLVESGGGLVQPGRSLTLSCAASTNIFSDSPMGWYRQAPGKQRELVAAIHGFSTLYADSVKGRFTISRDNAKNSIYLQMNSLRPEDTALYYCNKVPWGDYHPRNVAWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 495 - protein, 507 aa, Artificial Sequence
  Description of Artificial Sequence: Synthetic polypeptide
EVQLVESGGGLVQPGRSLTLSCAASTNIFSNSPMGWYRQAPGKQRELVAAIHGGSTLYADSVKGRFTISRDNAKNSIYLQMNSLRPEDTALYYCNKVPWGDYHPRNVHWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 496 - protein, 507 aa, Artificial Sequence
  Description of Artificial Sequence: Synthetic polypeptide
EVQLVESGGGLVQPGRSLTLSCAASTNIFSNSPMGWYRQAPGKQRELVAAIHGRSTLYADSVKGRFTISRDNAKNSIYLQMNSLRPEDTALYYCNKVPWGDYHPRNVMWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 497 - protein, 507 aa, Artificial Sequence
  Description of Artificial Sequence: Synthetic polypeptide
EVQLVESGGGLVQPGRSLTLSCAASTNIFSNSPMGWYRQAPGKQRELVAAIHGPSTLYADSVKGRFTISRDNAKNSIYLQMNSLRPEDTALYYCNKVPWGDYHPRNVTWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 498 - protein, 507 aa, Artificial Sequence
  Description of Artificial Sequence: Synthetic polypeptide
EVQLVESGGGLVQPGRSLTLSCAASTNIFSNSPMGWYRQAPGKQRELVAAIHGDSTLYADSVKGRFTISRDNAKNSIYLQMNSLRPEDTALYYCNKVPWGDYHPRNVRWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 499 - protein, 507 aa, Artificial Sequence
  Description of Artificial Sequence: Synthetic polypeptide
EVQLVESGGGLVQPGRSLTLSCAASTNIFSRSPMGWYRQAPGKQRELVAAIHGDSTLYADSVKGRFTISRDNAKNSIYLQMNSLRPEDTALYYCNKVPWGDYHPRNVTWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 500 - protein, 507 aa, Artificial Sequence
  Description of Artificial Sequence: Synthetic polypeptide
EVQLVESGGGLVQPGRSLTLSCAASTNIFSKSPMGWYRQAPGKQRELVAAIHGQSTLYADSVKGRFTISRDNAKNSIYLQMNSLRPEDTALYYCNKVPWGDYHPRNVTWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 501 - protein, 507 aa, Artificial Sequence
  Description of Artificial Sequence: Synthetic polypeptide
EVQLVESGGGLVQPGRSLTLSCAASTNIFSSSPMGWYRQAPGKQRELVAAIHGHSTLYADSVKGRFTISRDNAKNSIYLQMNSLRPEDTALYYCNKVPWGDYHPRNVTWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 502 - protein, 507 aa, Artificial Sequence
  Description of Artificial Sequence: Synthetic polypeptide
EVQLVESGGGLVQPGRSLTLSCAASTNIFSSSPMGWYRQAPGKQRELVAAIHGESTLYADSVKGRFTISRDNAKNSIYLQMNSLRPEDTALYYCNKVPWGDYHPRKVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 503 - protein, 507 aa, Artificial Sequence
  Description of Artificial Sequence: Synthetic polypeptide
EVQLVESGGGLVQPGRSLTLSCAASTNIFSRSPMGWYRQAPGKQRELVAAIHGNSTLYADSVKGRFTISRDNAKNSIYLQMNSLRPEDTALYYCNKVPWGIYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 504 - protein, 507 aa, Artificial Sequence
  Description of Artificial Sequence: Synthetic polypeptide
EVQLVESGGGLVQPGRSLTLSCAASTNIFSESPMGWYRQAPGKQRELVAAIHGNSTLYADSVKGRFTISRDNAKNSIYLQMNSLRPEDTALYYCNKVPWGTYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 505 - protein, 507 aa, Artificial Sequence
  Description of Artificial Sequence: Synthetic polypeptide
EVQLVESGGGLVQPGRSLTLSCAASTNIFSVSPMGWYRQAPGKQRELVAAIHGNSTLYADSVKGRFTISRDNAKNSIYLQMNSLRPEDTALYYCNKVPWGKYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 506 - protein, 507 aa, Artificial Sequence
  Description of Artificial Sequence: Synthetic polypeptide
EVQLVESGGGLVQPGRSLTLSCAASTNIFSVSPMGWYRQAPGKQRELVAAIHGNSTLYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 507 - protein, 507 aa, Artificial Sequence
  Description of Artificial Sequence: Synthetic polypeptide
EVQLVESGGGLVQPGRSLTLSCAASTNIFSKSPMGWYRQAPGKQRELVAAIHGNSTLYADSVKGRFTISRDNAKNSIYLQMNSLRPEDTALYYCNKVPWGDYHPREVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 508 - protein, 507 aa, Artificial Sequence
  Description of Artificial Sequence: Synthetic polypeptide
EVQLVESGGGLVQPGRSLTLSCAASTNIFSDSPMGWYRQAPGKQRELVAAIHGTSTLYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 509 - protein, 507 aa, Artificial Sequence
  Description of Artificial Sequence: Synthetic polypeptide
EVQLVESGGGLVQPGRSLTLSCAASTNIFSRSPMGWYRQAPGKQRELVAAIHGTSTLYADSVKGRFTISRDNAKNSIYLQMNSLRPEDTALYYCNKVPWGKYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 510 - protein, 507 aa, Artificial Sequence
  Description of Artificial Sequence: Synthetic polypeptide
EVQLVESGGGLVQPGRSLTLSCAASTNIFSHSPMGWYRQAPGKQRELVAAIHGTSTLYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 511 - protein, 507 aa, Artificial Sequence
  Description of Artificial Sequence: Synthetic polypeptide
EVQLVESGGGLVQPGRSLTLSCAASTNIFSTSPMGWYRQAPGKQRELVAAIHGTSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 512 - protein, 507 aa, Artificial Sequence
  Description of Artificial Sequence: Synthetic polypeptide
EVQLVESGGGLVQPGRSLTLSCAASTNIFSTSPMGWYRQAPGKQRELVAAIHGTSTLYADSVKGRFTISRDNAKNSIYLQMNSLRPEDTALYYCNKVPWGDYHPRNVQWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 513 - protein, 507 aa, Artificial Sequence
  Description of Artificial Sequence: Synthetic polypeptide
EVQLVESGGGLVQPGRSLTLSCAASTNIFSLSPMGWYRQAPGKQRELVAAIHGDSTLYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 514 - protein, 507 aa, Artificial Sequence
  Description of Artificial Sequence: Synthetic polypeptide
EVQLVESGGGLVQPGRSLTLSCAASTNIFSISPGGWYRQAPGKQRELVAAIHGSSTLYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 515 - protein, 507 aa, Artificial Sequence
  Description of Artificial Sequence: Synthetic polypeptide
EVQLVESGGGLVQPGRSLTLSCAASTNHFSISPMGWYRQAPGKQRELVAAIHGSSTLYADSVKGRFTISRDNAKNSIYLQMNSLRPEDTALYYCNKVPWGDYHPRVVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 516 - protein, 507 aa, Artificial Sequence
  Description of Artificial Sequence: Synthetic polypeptide
EVQLVESGGGLVQPGRSLTLSCAASTNIFSASPMGWYRQAPGKQRELVAAIHGSSTLYADSVKGRFTISRDNAKNSIYLQMNSLRPEDTALYYCNKVPWGDYHPRNVNWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 517 - protein, 507 aa, Artificial Sequence
  Description of Artificial Sequence: Synthetic polypeptide
EVQLVESGGGLVQPGRSLTLSCAASTNIFSASPMGWYRQAPGKQRELVAAIHGSSTLYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 518 - protein, 507 aa, Artificial Sequence
  Description of Artificial Sequence: Synthetic polypeptide
EVQLVESGGGLVQPGRSLTLSCAASTNISSISPMGWYRQAPGKQRELVAAIHGTSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 519 - protein, 507 aa, Artificial Sequence
  Description of Artificial Sequence: Synthetic polypeptide
EVQLVESGGGLVQPGRSLTLSCAASTNIESISPMGWYRQAPGKQRELVAAIHGTSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 520 - protein, 507 aa, Artificial Sequence
  Description of Artificial Sequence: Synthetic polypeptide
EVQLVESGGGLVQPGRSLTLSCAASTNIFSISPYGWYRQAPGKQRELVAAIHGTSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 521 - protein, 507 aa, Artificial Sequence
  Description of Artificial Sequence: Synthetic polypeptide
EVQLVESGGGLVQPGRSLTLSCAASTNIASISPMGWYRQAPGKQRELVAAIHGTSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 522 - protein, 507 aa, Artificial Sequence
  Description of Artificial Sequence: Synthetic polypeptide
EVQLVESGGGLVQPGRSLTLSCAASTNIASISPMGWYRQAPGKQRELVAAIHGKSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 523 - protein, 507 aa, Artificial Sequence
  Description of Artificial Sequence: Synthetic polypeptide
EVQLVESGGGLVQPGRSLTLSCAASTNIASISPMGWYRQAPGKQRELVAAIHGSSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 524 - protein, 507 aa, Artificial Sequence
  Description of Artificial Sequence: Synthetic polypeptide
EVQLVESGGGLVQPGRSLTLSCAASTNITSISPMGWYRQAPGKQRELVAAIHGDSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 525 - protein, 507 aa, Artificial Sequence
  Description of Artificial Sequence: Synthetic polypeptide
EVQLVESGGGLVQPGRSLTLSCAASTNIMSISPMGWYRQAPGKQRELVAAIHGNSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 526 - protein, 507 aa, Artificial Sequence
  Description of Artificial Sequence: Synthetic polypeptide
EVQLVESGGGLVQPGRSLTLSCAASTNITSISPMGWYRQAPGKQRELVAAIHGNSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 527 - protein, 507 aa, Artificial Sequence
  Description of Artificial Sequence: Synthetic polypeptide
EVQLVESGGGLVQPGRSLTLSCAASTNIVSISPMGWYRQAPGKQRELVAAIHGHSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 528 - protein, 507 aa, Artificial Sequence
  Description of Artificial Sequence: Synthetic polypeptide
EVQLVESGGGLVQPGRSLTLSCAASTNIVSISPMGWYRQAPGKQRELVAAIHGKSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 529 - protein, 507 aa, Artificial Sequence
  Description of Artificial Sequence: Synthetic polypeptide
EVQLVESGGGLVQPGRSLTLSCAASTNVVSISPMGWYRQAPGKQRELVAAIHGKSTLYADSVKGRFTISRDNAKNSIYLQMNSLRPEDTALYYCNKVPWGDYHPNNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 530 - protein, 507 aa, Artificial Sequence
  Description of Artificial Sequence: Synthetic polypeptide
EVQLVESGGGLVQPGRSLTLSCAASTNIISISPMGWYRQAPGKQRELVAAIHGASTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 531 - protein, 507 aa, Artificial Sequence
  Description of Artificial Sequence: Synthetic polypeptide
EVQLVESGGGLVQPGRSLTLSCAASTNIFSITPMGWYRQAPGKQRELVAAIHGASTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 532 - protein, 507 aa, Artificial Sequence
  Description of Artificial Sequence: Synthetic polypeptide
EVQLVESGGGLVQPGRSLTLSCAASTNITSISPMGWYRQAPGKQRELVAAIHGFETLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 533 - protein, 507 aa, Artificial Sequence
  Description of Artificial Sequence: Synthetic polypeptide
EVQLVESGGGLVQPGRSLTLSCAASTNIQSISPMGWYRQAPGKQRELVAAIHGFETLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 534 - protein, 507 aa, Artificial Sequence
  Description of Artificial Sequence: Synthetic polypeptide
EVQLVESGGGLVQPGRSLTLSCAASTSDFSISPMGWYRQAPGKQRELVAAIHGFETLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 535 - protein, 507 aa, Artificial Sequence
  Description of Artificial Sequence: Synthetic polypeptide
EVQLVESGGGLVQPGRSLTLSCAASTNIDSISPMGWYRQAPGKQRELVAAIHGFQTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 536 - protein, 507 aa, Artificial Sequence
  Description of Artificial Sequence: Synthetic polypeptide
EVQLVESGGGLVQPGRSLTLSCAASTNIMSISPMGWYRQAPGKQRELVAAIHGFSTVYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 537 - protein, 507 aa, Artificial Sequence
  Description of Artificial Sequence: Synthetic polypeptide
EVQLVESGGGLVQPGRSLTLSCAASTNIESISPMGWYRQAPGKQRELVAAIHGFSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 538 - protein, 507 aa, Artificial Sequence
  Description of Artificial Sequence: Synthetic polypeptide
EVQLVESGGGLVQPGRSLTLSCAASTNIFSSSPMGWYRQAPGKQRELVAAIHGFKTLYADSVKGRFTISRDNAKNSIYLQMNSLRPEDTARYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 539 - protein, 507 aa, Artificial Sequence
  Description of Artificial Sequence: Synthetic polypeptide
EVQLVESGGGLVQPGRSLTLSCAASTNIFSSSPMGWYRQAPGKQRELVAAIHGFSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 540 - protein, 507 aa, Artificial Sequence
  Description of Artificial Sequence: Synthetic polypeptide
EVQLVESGGGLVQPGRSLTLSCAASTNIFSNSPMGWYRQAPGKQRELVAAIHGFSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 541 - protein, 507 aa, Artificial Sequence
  Description of Artificial Sequence: Synthetic polypeptide
EVQLVESGGGLVQPGRSLTLSCAASTNIFSTSPMGWYRQAPGKQRELVAAIHGFSTIYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 542 - protein, 507 aa, Artificial Sequence
  Description of Artificial Sequence: Synthetic polypeptide
EVQLVESGGGLVQPGRSLTLSCAASTNIFSTSPMGWYRQAPGKQRELVAAIHGFSTIYADSVKGRFTISRDNAKNSIYLQMNSLRPEDTALYYCNKVPWGDYHPLNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 543 - protein, 507 aa, Artificial Sequence
  Description of Artificial Sequence: Synthetic polypeptide
EVQLVESGGGLVQPGRSLTLSCVASTNIFSTSPMGWYRQAPGKQRELVAAIHGFSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 544 - protein, 507 aa, Artificial Sequence
  Description of Artificial Sequence: Synthetic polypeptide
EVQLVESGGGLVQPGRSLTLSCAASTNIFSDSPMGWYRQAPGKQRELVAAIHGFSTFYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 545 - protein, 507 aa, Artificial Sequence
  Description of Artificial Sequence: Synthetic polypeptide
EVQLVESGGGLVQPGRSLTLSCAASTNIFSQSPMGWYRQAPGKQRELVAAIHGDSTLYADSVKGRFTISRDNAKNSIYLQMNSLRPEDTALYYCNKVPWGDYHPGNVCWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 546 - protein, 507 aa, Artificial Sequence
  Description of Artificial Sequence: Synthetic polypeptide
EVQLVESGGGLVQPGRSLTLSCAASTNIFSQSPMGWYRQAPGKQRELVAAIHGKSTLYADSVKGRFTISRDNAKNSIYLQMNSLRPEDTALYYCNKVPWGDYHPSNVYWGKGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 547 - protein, 507 aa, Artificial Sequence
  Description of Artificial Sequence: Synthetic polypeptide
EVQLVESGGGLVQPGRSLTLSCAASTNIFSRSPMGWYRQAPGKQRELVAAIHGESTLYADSVKGRFTISRDNAKNSIYLQMNSLRPEDTALYYCNKVPWGRYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 548 - protein, 507 aa, Artificial Sequence
  Description of Artificial Sequence: Synthetic polypeptide
EVQLVESGGGLVQPGRSLTLSCAASTNIFSRSPMGWYRQAPGKQRELVAAIHGISTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 549 - protein, 507 aa, Artificial Sequence
  Description of Artificial Sequence: Synthetic polypeptide
EVQLVESGGGLVQPGRSLTLSCAASTNIFSRSPMGWYRQAPGKQRELVAAIHGSSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 550 - protein, 507 aa, Artificial Sequence
  Description of Artificial Sequence: Synthetic polypeptide
EVQLVESGGGLVQPGRSLTLSCAASTNIFSGSPMGWYRQAPGKQRELVAAIHGNSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 551 - protein, 507 aa, Artificial Sequence
  Description of Artificial Sequence: Synthetic polypeptide
EVQLVESGGGLVQPGRSLTLSCAASSNIFSISPMGWYRQAPGKQRELVAAIHGSSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 552 - protein, 507 aa, Artificial Sequence
  Description of Artificial Sequence: Synthetic polypeptide
EVQLVESGGGLVQPGRSLTLSCAASTNIFSIYPMGWYRQAPGKQRELVAAIHGSSTLYADSVKGRFTISRDNAKNSIYLQMNSLRPEDTALYYCNKVPWGDYHPKNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 553 - protein, 507 aa, Artificial Sequence
  Description of Artificial Sequence: Synthetic polypeptide
EVQLVESGGGLVQPGRSLTLSCAASTNIFSKSPMGWYRQAPGKQRELVAAIHGSSTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 554 - protein, 507 aa, Artificial Sequence
  Description of Artificial Sequence: Synthetic polypeptide
EVQLVESGGGLVQPGRSLTLSCAASTNIFSKSPMGWYRQAPGKQRELVAAIHGSSTLYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 555 - protein, 507 aa, Artificial Sequence
  Description of Artificial Sequence: Synthetic polypeptide
EVQLVESGGGLVQPGRSLTLSCAASTNEFSISPMGWYRQAPGKQRELVAAIHGLSTLYADSVKGRFTISRDNAKNSIYLQMNSLRPEDTALYYCNKVPWGAYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 556 - protein, 507 aa, Artificial Sequence
  Description of Artificial Sequence: Synthetic polypeptide
EVQLVESGGGLVQPGRSLTLSCAASTNEFSISPMGWYRQAPGKQRELVAAIHGESTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 557 - protein, 507 aa, Artificial Sequence
  Description of Artificial Sequence: Synthetic polypeptide
EVQLVESGGGLVQPGRSLTLSCAASTNIPSISPMGWYRQAPGKQRELVAAIHGESTLYADSVKGRFTISRDNAKNSIYLQMNSLRPEDTALYYCNKVPWGDYHPRNVAWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 558 - protein, 507 aa, Artificial Sequence
  Description of Artificial Sequence: Synthetic polypeptide
EVQLVESGGGLVQPGRSLTLSCAASTNIPSISPMGWYRQAPGKQRELVAAIHGASTLYADSVKGRFTISRDNAKNSIYLQMNSLRPEDTALYYCNKVPWGDYHPRNVAWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 559 - protein, 507 aa, Artificial Sequence
  Description of Artificial Sequence: Synthetic polypeptide
EVQLVESGGGLVQPGRSLTLSCAASTNIPSISPMGWYRQAPGKQRELVAAIHGESTLYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 560 - protein, 507 aa, Artificial Sequence
  Description of Artificial Sequence: Synthetic polypeptide
EVQLVESGGGLVQPGRSLTLSCAASTNIPSISPMGWYRQAPGKQRELVAAIHGDSTLYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 561 - protein, 507 aa, Artificial Sequence
  Description of Artificial Sequence: Synthetic polypeptide
EVQLVESGGGLVQPGRSLTLSCAASTNITSISPMGWYRQAPGKQRELVAAIHGVSTLYADSVKGRFTISRDNAKNSIYLQMNSLRPEDTALYYCNKVPWGDYHPRNVQWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 562 - protein, 507 aa, Artificial Sequence
  Description of Artificial Sequence: Synthetic polypeptide
EVQLVESGGGLVQPGRSLTLSCAASTNIPSISPMGWYRQAPGKQRELVAAIHGQSTLYADSVKGRFTISRDNAKNSIYLQMNSLRPEDTALYYCNKVPWGDYHPRNVQWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 563 - protein, 507 aa, Artificial Sequence
  Description of Artificial Sequence: Synthetic polypeptide
EVQLVESGGGLVQPGRSLTLSCAASTNIVSISPMGWYRQAPGKQRELVAAIHGDSTLYADSVKGRFTISRDNAKNSIYLQMNSLRPEDTALYYCNKVPWGDYHPRNVSWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 564 - protein, 507 aa, Artificial Sequence
  Description of Artificial Sequence: Synthetic polypeptide
EVQLVESGGGLVQPGRSLTLSCAASSNIFSISPMGWYRQAPGKQRELVAAIHGESTLYADSVKGRFTISRDNAKNSIYLQMNSLRPEDTALYYCNKVPWGDYHPRNVTWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 565 - protein, 507 aa, Artificial Sequence
  Description of Artificial Sequence: Synthetic polypeptide
EVQLVESGGGLVQPGRSLTLSCAASTNIDSISPMGWYRQAPGKQRELVAAIHGESTLYADSVKGRFTISRDNAKNSIYLQMNSLRPEDTALYYCNKVPWGDYHPRNVTWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 566 - protein, 507 aa, Artificial Sequence
  Description of Artificial Sequence: Synthetic polypeptide
EVQLVESGGGLVQPGRSLTLSCAASTNIDSISPMGWYRQAPGKQRELVAAIHGSSTLYADSVKGRFTISRDNAKNSIYLQMNSLRPEDTALYYCNKVPWGDYHPRNVTWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 567 - protein, 507 aa, Artificial Sequence
  Description of Artificial Sequence: Synthetic polypeptide
EVQLVESGGGLVQPGRSLTLSCAASTNIRSISPMGWYRQAPGKQRELVAAIHGSSTLYADSVKGRFTISRDNAKNSIYLQMNSLRPEDTALYYCNKVPWGDYHPRNVVWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 568 - protein, 507 aa, Artificial Sequence
  Description of Artificial Sequence: Synthetic polypeptide
EVQLVESGGGLVQPGRSLTLSCAASTNITSISPMGWYRQAPGKQRELVAAISGFSTLYADSVKGRFTISRDNAKNSIYLQMNSLRPEDTALYYCNEVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 569 - protein, 507 aa, Artificial Sequence
  Description of Artificial Sequence: Synthetic polypeptide
EVQLVESGGGLVQPGRSLTLSCAASTNITSISPMGWYRQAPGKQRELVAAIHGESTLYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 570 - protein, 507 aa, Artificial Sequence
  Description of Artificial Sequence: Synthetic polypeptide
EVQLVESGGGLVQPGRSLTLSCAASTNITSVSPMGWYRQAPGKQRELVAAIHGPSTLYADSVKGRFTISRDNAKNSIYLQMNSLRPEDTALYYCNKVPWGDYHPTNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 571 - protein, 507 aa, Artificial Sequence
  Description of Artificial Sequence: Synthetic polypeptide
EVQLVESGGGLVQPGRSLTLSCAASTNIGSISPMGWYRQAPGKQRELVAAIHGQSTLYADSVKGRFTISRDNAKNSIYLQMNSLRPEDTALYYCNKVPWGDYHPQNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 572 - protein, 507 aa, Artificial Sequence
  Description of Artificial Sequence: Synthetic polypeptide
EVQLVESGGGLVQPGRSLTLSCAASTNIESISPMGWYRQAPGKQRELVAAIHGKSTLYADSVKGRFTISRDNAKNSIYLQMNSLRPEDTALYYCNKVPWGDYHPRRVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 573 - protein, 507 aa, Artificial Sequence
  Description of Artificial Sequence: Synthetic polypeptide
EVQLVESGGGLVQPGRSLTLSCAASTNIVSISPMGWYRQAPGKQRELVAAIHGDSTLYADSVKGRFTISRDNAKNSIYLQMNSLRPEDTALYYCNKVPWGDYHPRRVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 574 - protein, 507 aa, Artificial Sequence
  Description of Artificial Sequence: Synthetic polypeptide
EVQLVESGGGLVQPGRSLTLSCAASTNIDSISPMGWYRQAPGKQRELVAAIHGNSTLYADSVKGRFTISRDNAKNSIYLQMNSLRPEDTALYYCNKVPWGDYHPRMVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 575 - protein, 507 aa, Artificial Sequence
  Description of Artificial Sequence: Synthetic polypeptide
EVQLVESGGGLVQPGRSLTLSCAASTNIFMISPMGWYRQAPGKQRELVAAIHGDSTLYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 576 - protein, 507 aa, Artificial Sequence
  Description of Artificial Sequence: Synthetic polypeptide
EVQLVESGGGLVQPGRSLTLSCAASTNIFRISPMGWYRQAPGKQRELVAAIHGDSTLYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 577 - protein, 507 aa, Artificial Sequence
  Description of Artificial Sequence: Synthetic polypeptide
EVQLVESGGGLVQPGRSLTLSCAASTNIFSISPMGWYRQAPGKQRELVAAIHGDSTLYADSVKGRFTISRDNAKNSIYLQMNSLRPEDTALYYCNKVPWGEYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 578 - protein, 507 aa, Artificial Sequence
  Description of Artificial Sequence: Synthetic polypeptide
EVQLVESGGGLVQPGRSLTLSCAASTNIFSISPMGWYRQAPGKQRELVAAIHGDSTLYADSVKGRFTISRDNAKNSIYLQMNSLRPEDTALYYCNKVPWGKYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 579 - protein, 507 aa, Artificial Sequence
  Description of Artificial Sequence: Synthetic polypeptide
EVQLVESGGGLVQPGRSLTLSCAASTNIESISPMGWYRQAPGKQRELVAAIHGSSTLYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 580 - protein, 507 aa, Artificial Sequence
  Description of Artificial Sequence: Synthetic polypeptide
EVQLVESGGGLVQPGRSLTLSCAASTNIESISPMGWYRQAPGKQRELVAAIHGNSTLYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 581 - protein, 507 aa, Artificial Sequence
  Description of Artificial Sequence: Synthetic polypeptide
EVQLVESGGGLVQPGRSLTLSCAASTNISSISPMGWYRQAPGKQRELVAAIHGFSTLYADSVKGRFTISRDNAKNSIYLQMNSLRPEDTALYYCNKVPWGYYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 582 - protein, 507 aa, Artificial Sequence
  Description of Artificial Sequence: Synthetic polypeptide
EVQLVESGGGLVQPGRSLTLSCAASTNISSISPMGWYRQAPGKQRELVAAIHGHSTLYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 583 - protein, 507 aa, Artificial Sequence
  Description of Artificial Sequence: Synthetic polypeptide
EVQLVESGGGLVQPGRSLTLSCAASTNISSISPMGWYRQAPGKQRELVAAIHGFSTVYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 584 - protein, 507 aa, Artificial Sequence
  Description of Artificial Sequence: Synthetic polypeptide
EVQLVESGGGLVQPGRSLTLSCAASTNIFSIRPMGWYRQAPGKQRELVAAIHGFSTVYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 585 - protein, 507 aa, Artificial Sequence
  Description of Artificial Sequence: Synthetic polypeptide
EVQLVESGGGLVQPGRSLTLSCAASTNIFSIYPMGWYRQAPGKQRELVAAIHGFSTYYADSVKGRFTISRDNAKNSIYLQMNSLRPEDTALYYCNKVPWGSYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 586 - protein, 507 aa, Artificial Sequence
  Description of Artificial Sequence: Synthetic polypeptide
EVQLVESGGGLVQPGRSLTLSCAASTNIFNISPMGWYRQAPGKQRELVAAIHGFSTYYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 587 - protein, 507 aa, Artificial Sequence
  Description of Artificial Sequence: Synthetic polypeptide
EVQLVESGGGLVQPGRSLTLSCAASTNIFSSSPMGWYRQAPGKQRELVAAIHGFSTWYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 588 - protein, 507 aa, Artificial Sequence
  Description of Artificial Sequence: Synthetic polypeptide
EVQLVESGGGLVQPGRSLTLSCAASTNISSISPMGWYRQAPGKQRELVAAIHGFDTLYADSVKGRFTISRDNAKNSIYLQMNSLRPEDTALYYCNKVPWGDYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 589 - protein, 507 aa, Artificial Sequence
  Description of Artificial Sequence: Synthetic polypeptide
EVQLVESGGGLVQPGRSLTLSCAASTNIFSINPMGWYRQAPGKQRELVAAIHGFDTLYADSVKGRFTISRDNAKNSIYLQMNSLRPEDTALYYCNKVPWGDYHPRNVSWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 590 - protein, 507 aa, Artificial Sequence
  Description of Artificial Sequence: Synthetic polypeptide
EVQLVESGGGLVQPGRSLTLSCAASTNIFSITPMGWYRQAPGKQRELVAAIHGRSTLYADSVKGRFTISRDNAKNSIYLQMNSLRPEDTALYYCNKVPWGSYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 591 - protein, 507 aa, Artificial Sequence
  Description of Artificial Sequence: Synthetic polypeptide
EVQLVESGGGLVQPGRSLTLSCAASTNIFSITPMGWYRQAPGKQRELVAAIHGTSTLYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 592 - protein, 507 aa, Artificial Sequence
  Description of Artificial Sequence: Synthetic polypeptide
EVQLVESGGGLVQPGRSLTLSCAASTNIFSITPMGWYRQAPGKQRELVAAIHGESTLYADSVKGRFTISRDNAKNSIYLQMNSLRPEDTALYYCNKVPWGRYHPRNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 593 - protein, 507 aa, Artificial Sequence
  Description of Artificial Sequence: Synthetic polypeptide
EVQLVESGGGLVQPGRSLTLSCAASTNIFSITPMGWYRQAPGKQRELVAAIHGESTLYADSVKGRFTISRDNAKNSIYLQMNSLRPEDTALYYCNKVPWGDYHPRDVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 594 - protein, 507 aa, Artificial Sequence
  Description of Artificial Sequence: Synthetic polypeptide
EVQLVESGGGLVQPGRSLTLSCAASTNIFSTSPYGWYRQAPGKQRELVAAIHGFSTIYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 595 - protein, 507 aa, Artificial Sequence
  Description of Artificial Sequence: Synthetic polypeptide
EVQLVESGGGLVQPGRSLTLSCAASTNIFSTSPGGWYRQAPGKQRELVAAIHGFSTIYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 596 - protein, 507 aa, Artificial Sequence
  Description of Artificial Sequence: Synthetic polypeptide
EVQLVESGGGLVQPGRSLTLSCAASTNIFSITPYGWYRQAPGKQRELVAAIHGASTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 597 - protein, 507 aa, Artificial Sequence
  Description of Artificial Sequence: Synthetic polypeptide
EVQLVESGGGLVQPGRSLTLSCAASTNIFSITPGGWYRQAPGKQRELVAAIHGASTLYADSVKGRFTISRDNAKNSIYLQMNSLRPEDTALYYCNKVPWGDYHPGNVYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 598 - protein, 119 aa, Artificial Sequence
  Description of Artificial Sequence: Synthetic polypeptide
QVQLVESGGGLVQPGESLRLSCAASTNIFSISPMGWYRQAPGKQRELVAAIHGFSTLYADSVKGRFTISRDNAKNTIYLQMNSLKPEDTAVYYCNKVPWGDYHPRNVYWGQGTQVTVSS

SEQ ID NO: 599 - protein, 10 aa, Artificial Sequence
  Description of Artificial Sequence: Synthetic peptide
TNIFSISPMG

SEQ ID NO: 600 - protein, 14 aa, Artificial Sequence
  Description of Artificial Sequence: Synthetic peptide
AIHGFSTLYADSVK

SEQ ID NO: 601 - protein, 12 aa, Artificial Sequence
  Description of Artificial Sequence: Synthetic peptide
VPWGDYHPRNVY

What is claimed is:

1. A B cell maturation agent (BCMA) binding trispecific protein that comprises:
    (a) a first domain (A) which is a single chain variable fragment (scFv) that specifically binds to a human CD3;
    (b) a second domain (B) which is a single domain antibody that specifically binds to a human serum albumin protein; and
    (c) a third domain (C) which is a single domain antibody that specifically binds to a human BCMA comprising the sequence of SEQ ID NO: 468,
wherein the third domain comprises complementarity determining regions CDR1, CDR2, and CDR3 and wherein
    the CDR1 comprises the amino acid sequence of SEQ ID No. 76, the CDR2 comprises the amino acid sequence of SEQ ID No. 190, and the CDR3 comprises the amino acid sequence of SEQ ID No. 304.

2. The BCMA binding trispecific protein of claim 1, wherein the first domain, the second domain, and the third domain are independently humanized.

3. The BCMA binding trispecific protein of claim 1, wherein the third domain comprises the following formula:

f1-r1-f2-r2-f3-r3-f4 wherein, r1 is the CDR1; r2 is the CDR2; and r3 is the CDR3; and wherein f1, f2, f3 and f4 are framework residues selected so that said protein is from about 80% to about 99% identical to the amino acid sequence set forth in SEQ ID NO: 346 or SEQ ID NO: 598.

4. The BCMA binding trispecific protein of claim 3, wherein f1 comprises SEQ ID NO: 461 or 462, f2 comprises SEQ ID NO: 463, f3 comprises SEQ ID NO: 464 or 465, and f4 comprises SEQ ID NO: 466 or 467.

5. The BCMA binding trispecific protein of claim 1, wherein the third domain comprises a4 the amino sequence.

6. The BCMA binding trispecific protein of claim 1, wherein said protein has an elimination half-time of at least 12 hours, at least 20 hours, at least 25 hours, at least 30 hours, at least 35 hours, at least 40 hours, at least 45 hours, at least 50 hours, or at least 100 hours, when administered to a subject, wherein the subject is a human.

7. The BCMA binding trispecific protein of claim 2, wherein the third domain binds to an extracellular domain of BCMA.

8. The BCMA binding trispecific protein of claim 1, wherein the trispecific protein comprises the sequence of SEQ ID NO: 520.

9. The BCMA binding trispecific protein of claim 1, that further comprises linkers L1 and L2, wherein the domains of the protein are linked in the order H2N-(A)-L1-(C)-L2-(B)-COOH, H2N-(B)-L1-(A)-L2-(C)-COOH, H2N-(C)-L1-(B)-L2-(A)-COOH, H2N-(C)-L1-(A)-L2-(B)-COOH, H2N-(A)-L1-(B)-L2-(C)-COOH or H2N-(B)-L1-(C)-L2-(A)-COOH.

10. The BCMA binding trispecific protein of claim wherein the domains are linked in the order $H_2N$-(C)-L1-(B)-L2-(A)-COOH.

11. The BCMA binding trispecific protein of claim 10, wherein the linkers L1 and L2 are each independently selected from a group consisting of $(GS)_n$ (SEQ ID NO: 472), $(GGS)_n$ (SEQ ID NO: 473), $(GGGS)_n$ (SEQ ID NO: 474), $(GGSG)_n$ (SEQ ID NO: 475), $(GGSGG)_n$ (SEQ ID NO: 476), $(GGGGS)_n$ (SEQ ID NO: 477), $(GGGGG)_n$ (SEQ ID NO: 478) and $(GGG)_n$ (SEQ ID NO: 479) wherein n is 1, 2, 3, 4, 5, 6, 7, 8, 9, or 10.

12. A method for the treatment or amelioration of a tumorous disease associated with BCMA in a subject having the tumorous disease, comprising administering to the subject a pharmaceutical composition that comprises the BCMA binding trispecific protein of claim 1.

13. A method for the treatment or amelioration of a tumorous disease associated with BCMA in a subject having the tumorous disease, comprising administering to the subject a pharmaceutical composition that comprises the BCMA binding trispecific protein of claim 8.

* * * * *

UNITED STATES PATENT AND TRADEMARK OFFICE
CERTIFICATE OF CORRECTION

PATENT NO. : 11,136,403 B2
APPLICATION NO. : 16/159554
DATED : October 5, 2021
INVENTOR(S) : Holger Wesche et al.

Page 1 of 1

It is certified that error appears in the above-identified patent and that said Letters Patent is hereby corrected as shown below:

In the Claims

In Claim 5, should read:
The BCMA binding trispecific protein of claim 1, wherein the third domain comprises the amino sequence of SEQ ID NO: 383.

In Claim 7, should read:
The BCMA binding trispecific protein of claim 1, wherein the third domain binds to an extracellular domain of BCMA.

In Claim 10, should read:
The BCMA binding trispecific protein of claim 9, wherein the domains are linked in the order $H_2N\text{-}(C)\text{-}L1\text{-}(B)\text{-}L2\text{-}(A)\text{-}COOH$.

Signed and Sealed this
Sixteenth Day of November, 2021

Drew Hirshfeld
*Performing the Functions and Duties of the
Under Secretary of Commerce for Intellectual Property and
Director of the United States Patent and Trademark Office*